United States Patent 9,782,462 (MODIFIED POLYNUCLEOTIDES FOR THE PRODUCTION OF PROTEINS ASSOCIATED WITH HUMAN DISEASE) - sequence listing, part 38

SEQ ID NO: 64980 - protein, 450 aa, Homo sapiens
MEQAPPDPERQLQPAPLEPLGSPDAGLGAAVGKEAEGAGEESSGVDTMTHNNFWLKKIEISVSEAEKRTGRNAMNMQETYTAYLIETRSVEHTDGQSVLTDSLWRRYSEFELLRSYLLVYYPHIVVPPLPEKRAEFVWHKLSADNMDPDFVERRRIGLENFLLRIASHPILCRDKIFYLFLTQEGNWKETVNETGFQLKADSRLKALNATFRVKNPDKRFTDLKHYSDELQSVISHLLRVRARVADRLYGVYKVHGNYGRVFSEWSAIEKEMGDGLQSAGHHMDVYASSIDDILEDEEHYADQLKEYLFYAEALRAVCRKHELMQYDLEMAAQDLASKKQQCEELVTGTVRTFSLKGMTTKLFGQETPEQREARIKVLEEQINEGEQQLKSKNLEGREFVKNAWADIERFKEQKNRDLKEALISYAVMQISMCKKGIQVWTNAKECFSKM

SEQ ID NO: 64981 - protein, 305 aa, Homo sapiens
MDPDFVERRRIGLENFLLRIASHPILCRDKIFYLFLTQEGNWKETVNETGFQLKADSRLKALNATFRVKNPDKRFTDLKHYSDELQSVISHLLRVRARVADRLYGVYKVHGNYGRVFSEWSAIEKEMGDGLQSAGHHMDVYASSIDDILEDEEHYADQLKEYLFYAEALRAVCRKHELMQYDLEMAAQDLASKKQQCEELVTGTVRTFSLKGMTTKLFGQETPEQREARIKVLEEQINEGEQQLKSKNLEGREFVKNAWADIERFKEQKNRDLKEALISYAVMQISMCKKGIQVWTNAKECFSKM

SEQ ID NO: 64982 - protein, 404 aa, Homo sapiens
MAAVPELLQQQEEDRSKLRSVSVDLNVDPSLQIDIPDALSERDKVKFTVHTKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAKDLLYRRTKALIDYENSNKALDKARLKSKDVKLAEAHQQECCQKFEQLSESAKEELINFKRKRVAAFRKNLIEMSELEIKHARNNVSLLQSCIDLFKNN

SEQ ID NO: 64983 - protein, 404 aa, Homo sapiens; identical to SEQ ID NO: 64982

SEQ ID NO: 64984 - protein, 228 aa, Homo sapiens
MAAVPELLQQQEEDRSKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIK

SEQ ID NO: 64985 - protein, 269 aa, Homo sapiens
MAAVPELLQQQEEDRSKLRSVSVDLNVDPSLQIDIPDALSERDKVKFTVHTKIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAK

SEQ ID NO: 64986 - protein, 294 aa, Homo sapiens
MTTLTEIKLLPSLVLLVCCEYLAIFKKTVAMHEVFLCRVAAHPILRRDLNFHVFLEYNQDLSVRGKNKKEKLEDFFKNMVKSADGVIVSGVKDVDDFFEHERTFLLEYHNRVKDASAKSDRMTRSHKSAADDYNRIGSSLYALGTQDSTDICKFFLKVSELFDKTRKIEARVSADEDLKLSDLLKYYLRESQAAKDLLYRRSRSLVDYENANKALDKARAKNKDVLQAETSQQLCCQKFEKISESAKQELIDFKTRRVAAFRKNLVELAELELKHAKGNLQLLQNCLAVLNGDT

SEQ ID NO: 64987 - protein, 418 aa, Homo sapiens
MRACAGPRLGAAMMEGLDDGPDFLSEEDRGLKAINVDLQSDAALQVDISDALSERDKVKFTVHTKSSLPNFKQNEFSVVRQHEEFIWLHDSFVENEDYAGYIIPPAPPRPDFDASREKLQKLGEGEGSMTKEEFTKMKQELEAEYLAIFKKTVAMHEVFLCRVAAHPILRRDLNFHVFLEYNQDLSVRGKNKKEKLEDFFKNMVKSADGVIVSGVKDVDDFFEHERTFLLEYHNRVKDASAKSDRMTRSHKSAADDYNRIGSSLYALGTQDSTDICKFFLKVSELFDKTRKIEARVSADEDLKLSDLLKYYLRESQAAKDLLYRRSRSLVDYENANKALDKARAKNKDVLQAETSQQLCCQKFEKISESAKQELIDFKTRRVAAFRKNLVELAELELKHAKGNLQLLQNCLAVLNGDT

SEQ ID NO: 64988 - protein, 290 aa, Homo sapiens
MTKEEFTKMKQELEAEYLAIFKKTVAMHEVFLCRVAAHPILRRDLNFHVFLEYNQDLSVRGKNKKEKLEDFFKNMVKSADGVIVSGVKDVDDFFEHERTFLLEYHNRVKDASAKSDRMTRSHKSAADDYNRIGSSLYALGTQDSTDICKFFLKVSELFDKTRKIEARVSADEDLKLSDLLKYYLRESQAAKDLLYRRSRSLVDYENANKALDKARAKNKDVLQAETSQQLCCQKFEKISESAKQELIDFKTRRVAAFRKNLVELAELELKHAKGNLQLLQNCLAVLNGDT

SEQ ID NO: 64989 - protein, 290 aa, Homo sapiens; identical to SEQ ID NO: 64988

SEQ ID NO: 64990 - protein, 395 aa, Homo sapiens
MKIPLNKFPGFAKPGTEQYLLAKQLAKPKEKIPIIVGDYGPMWVYPTSTFDCVVADPRKGSKMYGLKSYIEYQLTPTNTNRSVNHRYKHFDWLYERLLVKFGSAIPIPSLPDKQVTGRFEEEFIKMRMERLQAWMTRMCRHPVISESEVFQQFLNFRDEKEWKTGKRKAERDELAGVMIFSTMEPEAPDLDLVEIEQKCEAVGKFTKAMDDGVKELLTVGQEHWKRCTGPLPKEYQKIGKALQSLATVFSSSGYQGETDLNDAITEAGKTYEEIASLVAEQPKKDLHFLMECNHEYKGFLGCFPDIIGTHKGAIEKVKESDKLVATSKITLQDKQNMVKRVSIMSYALQAEMNHFHSNRIYDYNSVIRLYLEQQVQFYETIAEKLRQALSRFPVM

SEQ ID NO: 64991 - protein, 595 aa, Homo sapiens
MATKARVMYDFAAEPGNNELTVNEGEIITITNPDVGGGWLEGRNIKGERGLVPTDYVEILPSDGKDQFSCGNSVADQAFLDSLSASTAQASSSAASNNHQVGSGNDPWSAWSASKSGNWESSEGWGAQPEGAGAQRNTNTPNNWDTAFGHPQAYQGPATGDDDDWDEDWDGPKSSSYFKDSESADAGGAQRGNSRASSSSMKIPLNKFPGFAKPGTEQYLLAKQLAKPKEKIPIIVGDYGPMWVYPTSTFDCVVADPRKGSKMYGLKSYIEYQLTPTNTNRSVNHRYKHFDWLYERLLVKFGSAIPIPSLPDKQVTGRFEEEFIKMRMERLQAWMTRMCRHPVISESEVFQQFLNFRDEKEWKTGKRKAERDELAGVMIFSTMEPEAPDLDLVEIEQKCEAVGKFTKAMDDGVKELLTVGQEHWKRCTGPLPKEYQKIGKALQSLATVFSSSGYQGETDLNDAITEAGKTYEEIASLVAEQPKKDLHFLMECNHEYKGFLGCFPDIIGTHKGAIEKVKESDKLVATSKITLQDKQNMVKRVSIMSYALQAEMNHFHSNRIYDYNSVIRLYLEQQVQFYETIAEKLRQALSRFPVM

SEQ ID NO: 64992 - protein, 595 aa, Homo sapiens; identical to SEQ ID NO: 64991

SEQ ID NO: 64993 - protein, 435 aa, Homo sapiens
MGLSFSLFPLRNHVNVEGATHKQVVDLIRAGEKELILTVLSVPPHEADNLDPSDDSLGQSFYDYTEKQAVPISVPRYKHVEQNGEKFVVYNVYMAGRQLCSKRYREFAILHQNLKREFANFTFPRLPGKWPFSLSEQQLDARRRGLEEYLEKVCSIRVIGESDIMQEFLSESDENYNGVSDVELRVALPDGTTVTVRVKKNSTTDQVYQAIAAKVGMDSTTVNYFALFEVISHSFVRKLAPNEFPHKLYIQNYTSAVPGTCLTIRKWLFTTEEEILLNDNDLAVTYFFHQAVDDVKKGYIKAEEKSYQLQKLYEQRKMVMYLNMLRTCEGYNEIIFPHCACDSRRKGHVITAISITHFKLHACTEEGQLENQVIAFEWDEMQRWDTDEEGMAFCFEYARGEKKPRWVKIFTPYFNYMHECFERVFCELKWRKEEY

SEQ ID NO: 64994 - protein, 528 aa, Homo sapiens
MADEDGEGIHPSAPHRNGGGGGGGGSGLHCAGNGGGGGGGPRVVRIVKSESGYGFNVRGQVSEGGQLRSINGELYAPLQHVSAVLPGGAADRAGVRKGDRILEVNHVNVEGATHKQVVDLIRAGEKELILTVLSVPPHEADNLDPSDDSLGQSFYDYTEKQAVPISVPRYKHVEQNGEKFVVYNVYMAGRQLCSKRYREFAILHQNLKREFANFTFPRLPGKWPFSLSEQQLDARRRGLEEYLEKVCSIRVIGESDIMQEFLSESDENYNGVSDVELRVALPDGTTVTVRVKKNSTTDQVYQAIAAKVGMDSTTVNYFALFEVISHSFVRKLAPNEFPHKLYIQNYTSAVPGTCLTIRKWLFTTEEEILLNDNDLAVTYFFHQAVDDVKKGYIKAEEKSYQLQKLYEQRKMVMYLNMLRTCEGYNEIIFPHCACDSRRKGHVITAISITHFKLHACTEEGQLENQVIAFEWDEMQRWDTDEEGMAFCFEYARGEKKPRWVKIFTPYFNYMHECFERVFCELKWRKEEY

SEQ ID NO: 64995 - protein, 541 aa, Homo sapiens
MADEDGEGIHPSAPHRNGGGGGGGGSGLHCAGNGGGGGGGPRVVRIVKSESGYGFNVRGQVSEGGQLRSINGELYAPLQHVSAVLPGGAADRAGVRKGDRILEVNHVNVEGATHKQVVDLIRAGEKELILTVLSVPPHEADNLDPSDDSLGQSFYDYTEKQAVPISVPRYKHVEQNGEKFVVYNVYMAGRQLCSKRYREFAILHQNLKREFANFTFPRLPGKWPFSLSEQQLDARRRGLEEYLEKVCSIRVIGESDIMQEFLSESDENYNGVSDVELRVALPDGTTVTVRVKKNSTTDQVYQAIAAKVGMDSTTVNYFALFEVISHSFVRKLAPNEFPHKLYIQNYTSAVPGTCLTIRKWLFTTEEEILLNDNDLAVTYFFHQAVDDVKKGYIKAEEKSYQLQKLYEQRKMVMYLNMLRTCEGYNEIIFPHCACDSRRKGHVITAISITHFKLHACTEEGQLENQVIAFEWDEMQRWDTDEEGMAFCFEYARGEKKPRWVKIFTPYFNYMHECFERVFCELKWRKENIFQMARSQQRDVAT

SEQ ID NO: 64996 - protein, 879 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGSQPQEPENKKCSCVMCFPKGVPRSQEARTESSQASDMMDTMDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMENKFLPEPPSTRKKRILESHNNTLVDPCEEHKKKNPDASVKFSEFLKKCSETWKTIFAKEKGKFEDMAKADKAHYEREMKTYIPPKGEKKKKFKDPNAPKRPPLAFFLFCSEYRPKIKGEHPGLSIDDVVKKLAGMWNNTAAADKQFYEKKAAKLKEKYKKDIAAYRAKGKPNSAKKRVVKAEKSKKKKEEEEDEEDEQEEENEEDDDK

SEQ ID NO: 64997 - protein, 885 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGSQPQEPENKKCSCVMCFPKGVPRSQEARTESSQASDMMDTMDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMENKFLPEPPSTRKKRILESHNNTLVDPCPENSNICEVCNKWGRLFCCDTCPRSFHEHCHIPSVEANKNPWSCIFCRIKTIQERCPESQSGHQESEVLMRQMLPEEQLKCEFLLLKVYCDSKSCFFASEPYYNREGSQGPQKPMWLNKVKTSLNEQMYTRVEGFVQDMRLIFHNHKEFYREDKFTRLGIQVQDIFEKNFRNIFAIQETSKNIIMFI

SEQ ID NO: 64998 - protein, 473 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRQLKKKKKKKQCHPQPQPQRGLLEQS

SEQ ID NO: 64999 - protein, 688 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGSQPQEPENKKCSCVMCFPKGVPRSQEARTESSQASDMMDTMDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMENKFLPEPPSTRKKVMIK

SEQ ID NO: 65000 - protein, 480 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGKED

SEQ ID NO: 65001 - protein, 355 aa, Homo sapiens
MDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMERILESHNNTLVDPCPENSNICEVCNKWGRLFCCDTCPRSFHEHCHIPSVEANKNPWSCIFCRIKTIQERCPESQSGHQESEVLMRQMLPEEQLKCEFLLLKVYCDSKSCFFASEPYYNREGSQGPQKPMWLNKVKTSLNEQMYTRVEGFVQDMRLIFHNHKEFYREDKFTRLGIQVQDIFEKNFRNIFAIQETSKNIIMFI

SEQ ID NO: 65002 - protein, 452 aa, Homo sapiens
MAGGGGDLSTRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHAPMTSRSTSTWRIPSRKRRFSSSDFSDLSNGEELQETCSSSLRRGSGKED

SEQ ID NO: 65003 - protein, 445 aa, Homo sapiens
MMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGKED

SEQ ID NO: 65004 - protein, 713 aa, Homo sapiens
MFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYEWQSRDTPILLEAPTGLAEGSSLHTPLALPPPQPPQPSCSPCAPRVSEPGTSSQQSDEILSESPSPSDPVLPLPALIQEGRSTSVTNDKLTSKMNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPGGTASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKRKNSDECEVCCQGGQLLCCGTCPRVFHEDCHIPPVEAKRMLWSCTFCRMKRSSGSQQCHHVSKTLERQMQPQDQLKCEFLLLKAYCHPQSSFFTGIPFNIRDYGEPFQEAMWLDLVKERLITEMYTVAWFVRDMRLMFRNHKTFYKASDFGQVGLDLEAEFEKDLKDVLGFHEANDGGFWTLP

SEQ ID NO: 65005 - protein, 549 aa, Homo sapiens
MFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYEWQSRDTPILLEAPTGLAEGSSLHTPLALPPPQPPQPSCSPCAPRVSEPGTSSQQSDEILSESPSPSDPVLPLPALIQEGRSTSVTNDKLTSKMNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPGGTASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKSGLLLCPPRINLKRELNSK

SEQ ID NO: 65006 - protein, 251 aa, Homo sapiens
MPEIRDNSPEPNDPEEPQEVSSTPSDKKGKKRKRCIWSTPKRRHKKKSLPGEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKSGLLLCPPRINLKRELNSK

SEQ ID NO: 65007 - protein, 689 aa, Homo sapiens
MFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYEWQSRDTPILLEAPTGLAEGSSLHTPLALPPPQPPQPSCSPCAPRVSEPGTSSQQSDEILSESPSPSDPVLPLPALIQEGRSTSVTNDKLTSKMNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPGGTASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKRKNSDECEVCCQGGQLLCCGTCPRVFHEDCHIPPVEAKRMLWSCTFCRMKRSSGSQQCHHVSKTLERQMQPQDQLIRDYGEPFQEAMWLDLVKERLITEMYTVAWFVRDMRLMFRNHKTFYKASDFGQVGLDLEAEFEKDLKDVLGFHEANDGGFWTLP

SEQ ID NO: 65008 - protein, 547 aa, Homo sapiens
MFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYEWQSRDTPILLEAPTGLAEGSSLHTPLALPPPQPPQPSCSPCAPRVSEPGTSSQQSDEILSESPSPSDPVLPLPALIQEGRSTSVTNDKLTSKMNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPGASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKSGLLLCPPRINLKRELNSK

SEQ ID NO: 65009 - protein, 221 aa, Homo sapiens
MFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYEWQSRDTPILLEAPTGLAEGSSLHTPLALPPPQPPQPSCSPCAPRVSEPGTSSQQSDEILSESPSPSDPVLPLPALIQEGRSTSVTNDKLTSKMNAEEDSEEMPSLLTSTV

SEQ ID NO: 65010 - protein, 101 aa, Homo sapiens
MFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYR

SEQ ID NO: 65011 - protein, 555 aa, Homo sapiens
MGRGFRMFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYEWQSRDTPILLEAPTGLAEGSSLHTPLALPPPQPPQPSCSPCAPRVSEPGTSSQQSDEILSESPSPSDPVLPLPALIQEGRSTSVTNDKLTSKMNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPGGTASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKSGLLLCPPRINLKRELNSK

SEQ ID NO: 65012 - protein, 781 aa, Homo sapiens
MTAPEKPVKQEEMAALDVDSGGGGGGGGGHGEYLQQQQQHGNGAVAAAAAAQDTQPSPLALLAATCSKIGPPSPGDDEEEAAAAAGAPAAAGATGDLASAQLGGAPNRWEVLSATPTTIKDEAGNLVQIPSAATSSGQYVLPLQNLQNQQIFSVAPGSDSSNGTVSSVQYQVIPQIQSADGQQVQIGFTGSSDNGGINQESSQIQIIPGSNQTLLASGTPSANIQNLIPQTGQVQVQGVAIGGSSFPGQTQVVANVPLGLPGNITFVPINSVDLDSLGLSGSSQTMTAGINADGHLINTGQAMDSSDNSERTGERVSPDINETNTDTDLFVPTSSSSQLPVTIDSTGILQQNTNSLTTSSGQVHSSDLQGNYIQSPVSEETQAQNIQVSTAQPVVQHLQLQESQQPTSQAQIVQGITPQTIHGVQASGQNISQQALQNLQLQLNPGTFLIQAQTVTPSGQVTWQTFQVQGVQNLQNLQIQNTAAQQITLTPVQTLTLGQVAAGGAFTSTPVSLSTGQLPNLQTVTVNSIDSAGIQLHPGENADSPADIRIKEEEPDPEEWQLSGDSTLNTNDLTHLRVQVVDEEGDQQHQEGKRLRRVACTCPNCKEGGGRGTNLGKKKQHICHIPGCGKVYGKTSHLRAHLRWHSGERPFVCNWMYCGKRFTRSDELQRHRRTHTGEKKFVCPECSKRFMRSDHLAKHIKTHQNKKGIHSSSTVLASVEAARDDTLITAGGTTLILANIQQGSVSGIGTVNTSATSNQDILTNTEIPLQLVTVSGNETME

SEQ ID NO: 65013 - protein, 738 aa, Homo sapiens
  MOD_RES (1)..(1): Any amino acid
XPEKPVKQEEMAALDVDSGGGGGGGGGHGEYLQQQQQHGNGAVAAAAAAQTGDLASAQLGGAPNRWEVLSATPTTIKDEAGNLVQIPSAATSSGQYVLPLQNLQNQQIFSVAPGSDSSNGTVSSVQYQVIPQIQSADGQQVQIGFTGSSDNGGINQESSQIQIIPGSNQTLLASGTPSANIQNLIPQTGQVQVQGVAIGGSSFPGQTQVVANVPLGLPGNITFVPINSVDLDSLGLSGSSQTMTAGINADGHLINTGQAMDSSDNSERTGERVSPDINETNTDTDLFVPTSSSSQLPVTIDSTGILQQNTNSLTTSSGQVHSSDLQGNYIQSPVSEETQAQNIQVSTAQPVVQHLQLQESQQPTSQAQIVQGITPQTIHGVQASGQNISQQALQNLQLQLNPGTFLIQAQTVTPSGQVTWQTFQVQGVQNLQNLQIQNTAAQQITLTPVQTLTLGQVAAGGAFTSTPVSLSTGQLPNLQTVTVNSIDSAGIQLHPGENADSPADIRIKEEEPDPEEWQLSGDSTLNTNDLTHLRVQVVDEEGDQQHQEGKRLRRVACTCPNCKEGGGRGTNLGKKKQHICHIPGCGKVYGKTSHLRAHLRWHSGERPFVCNWMYCGKRFTRSDELQRHRRTHTGEKKFVCPECSKRFMRSDHLAKHIKTHQNKKGIHSSSTVLASVEAARDDTLITAGGTTLILANIQQGSVSGIGTVNTSATSNQDILTNTEIPLQLVTVSGNETME

SEQ ID NO: 65014 - protein, 713 aa, Homo sapiens
IGPPSPGDDEEEAAAAAGAPAAAGATGDLASAQLGGAPNRWEVLSATPTTIKDEAGNLVQIPSAATSSGQYVLPLQNLQNQQIFSVAPGSDSSNGTVSSVQYQVIPQIQSADGQQVQIGFTGSSDNGGINQESSQIQIIPGSNQTLLASGTPSANIQNLIPQTGQVQVQGVAIGGSSFPGQTQVVANVPLGLPGNITFVPINSVDLDSLGLSGSSQTMTAGINADGHLINTGQAMDSSDNSERTGERVSPDINETNTDTDLFVPTSSSSQLPVTIDSTGILQQNTNSLTTSSGQVHSSDLQGNYIQSPVSEETQAQNIQVSTAQPVVQHLQLQESQQPTSQAQIVQGITPQTIHGVQASGQNISQQALQNLQLQLNPGTFLIQAQTVTPSGQVTWQTFQVQGVQNLQNLQIQNTAAQQITLTPVQTLTLGQVAAGGAFTSTPVSLSTGQLPNLQTVTVNSIDSAGIQLHPGENADSPADIRIKEEEPDPEEWQLSGDSTLNTNDLTHLRVQVVDEEGDQQHQEGKRLRRVACTCPNCKEGGGRGTNLGKKKQHICHIPGCGKVYGKTSHLRAHLRWHSGERPFVCNWMYCGKRFTRSDELQRHRRTHTGEKKFVCPECSKRFMRSDHLAKHIKTHQNKKGIHSSSTVLASVEAARDDTLITAGGTTLILANIQQGSVSGIGTVNTSATSNQDILTNTEIPLQLVTVSGNETME

SEQ ID NO: 65015 - protein, 728 aa, Homo sapiens
MAALDVDSGGGGGGGGGHGEYLQQQQQHGNGAVAAAAAAQTGDLASAQLGGAPNRWEVLSATPTTIKDEAGNLVQIPSAATSSGQYVLPLQNLQNQQIFSVAPGSDSSNGTVSSVQYQVIPQIQSADGQQVQIGFTGSSDNGGINQESSQIQIIPGSNQTLLASGTPSANIQNLIPQTGQVQVQGVAIGGSSFPGQTQVVANVPLGLPGNITFVPINSVDLDSLGLSGSSQTMTAGINADGHLINTGQAMDSSDNSERTGERVSPDINETNTDTDLFVPTSSSSQLPVTIDSTGILQQNTNSLTTSSGQVHSSDLQGNYIQSPVSEETQAQNIQVSTAQPVVQHLQLQESQQPTSQAQIVQGITPQTIHGVQASGQNISQQALQNLQLQLNPGTFLIQAQTVTPSGQVTWQTFQVQGVQNLQNLQIQNTAAQQITLTPVQTLTLGQVAAGGAFTSTPVSLSTGQLPNLQTVTVNSIDSAGIQLHPGENADSPADIRIKEEEPDPEEWQLSGDSTLNTNDLTHLRVQVVDEEGDQQHQEGKRLRRVACTCPNCKEGGGRGTNLGKKKQHICHIPGCGKVYGKTSHLRAHLRWHSGERPFVCNWMYCGKRFTRSDELQRHRRTHTGEKKFVCPECSKRFMRSDHLAKHIKTHQNKKGIHSSSTVLASVEAARDDTLITAGGTTLILANIQQGSVSGIGTVNTSATSNQDILTNTEIPLQLVTVSGNETME

SEQ ID NO: 65016 - protein, 784 aa, Homo sapiens
MSDQKKEEEEEAAAAAAMATEGGKTSEPENNNKKPKTSGSQDSQPSPLALLAATCSKIGTPGENQATGQQQIIIDPSQGLVQLQNQPQQLELVTTQLAGNAWQLVASTPPASKENNVSQPASSSSSSSSSNNGSASPTKTKSGNSSTPGQFQVIQVQNPSGSVQYQVIPQLQTVEGQQIQINPTSSSSLQDLQGQIQLISAGNNQAILTAANRTASGNILAQNLANQTVPVQIRPGVSIPLQLQTLPGTQAQVVTTLPINIGGVTLALPVINNVAAGGGTGQVGQPAATADSGTSNGNQLVSTPTNTTTSASTMPESPSSSTTCTTTASTSLTSSDTLVSSADTGQYASTSASSSERTIEESQTPAATESEAQSSSQLQPNGMQNAQDQSNSLQQVQIVGQPILQQIQIQQPQQQIIQAIPPQSFQLQSGQTIQTIQQQPLQNVQLQAVNPTQVLIRAPTLTPSGQISWQTVQVQNIQSLSNLQVQNAGLSQQLTITPVSSSGGTTLAQIAPVAVAGAPITLNTAQLASVPNLQTVSVANLGAAGVQVQGVPVTITSVAGQQQGQDGVKVQQATIAPVTVAVGGIANATIGAVSPDQLTQVHLQQGQQTSDQEVQPGKRLRRVACSCPNCREGEGRGSNEPGKKKQHICHIEGCGKVYGKTSHLRAHLRWHTGERPFICNWMFCGKRFTRSDELQRHRRTHTGEKRFECPECSKRFMRSDHLSKHVKTHQNKKGGGTALAIVTSGELDSSVTEVLGSPRIVTVAAISQDSNPATPNVSTNMEEF

SEQ ID NO: 65017 - protein, 143 aa, Homo sapiens
MSDQKKEEEEEAAAAAAMATEGGKTSEPENNNKKPKTSGSQDSQPSPLALLAATCSKIGTPGENQATGQQQRNLLETLGNLLPPLLLLQKRITFLNQPLVRLVLPAVITGVHLLQKLNQVILPPLVNFKSYKYKIQVVVYSTK

SEQ ID NO: 65018 - protein, 431 aa, Homo sapiens
MASSLLEEEVHYGSSPLAMLTAACSKFGGSSPLRDSTTLGKAGTKKPYSVGSDLSASKTMGDAYPAPFTSTNGLLSPAGSPPAPTSGYANDYPPFSHSFPGPTGTQDPGLLVPKGHSSSDCLPSVYTSLDMTHPYGSWYKAGIHAGISPGPGNTPTPWWDMHPGGNWLGGGQGQGDGLQGTLPTGPAQPPLNPQLPTYPSDFAPLNPAPYPAPHLLQPGPQHVLPQDVYKPKAVGNSGQLEGSGGAKPPRGASTGGSGGYGGSGAGRSSCDCPNCQELERLGAAAAGLRKKPIHSCHIPGCGKVYGKASHLKAHLRWHTGERPFVCNWLFCGKRFTRSDELERHVRTHTREKKFTCLLCSKRFTRSDHLSKHQRTHGEPGPGPPPSGPKELGEGRSTGEEEASQTPRPSASPATPEKAPGGSPEQSNLLEI

SEQ ID NO: 65019 - protein, 431 aa, Homo sapiens; identical to SEQ ID NO: 65018

SEQ ID NO: 65020 - protein, 413 aa, Homo sapiens
MLTAACSKFGGSSPLRDSTTLGKAGTKKPYSVGSDLSASKTMGDAYPAPFTSTNGLLSPAGSPPAPTSGYANDYPPFSHSFPGPTGTQDPGLLVPKGHSSSDCLPSVYTSLDMTHPYGSWYKAGIHAGISPGPGNTPTPWWDMHPGGNWLGGGQGQGDGLQGTLPTGPAQPPLNPQLPTYPSDFAPLNPAPYPAPHLLQPGPQHVLPQDVYKPKAVGNSGQLEGSGGAKPPRGASTGGSGGYGGSGAGRSSCDCPNCQELERLGAAAAGLRKKPIHSCHIPGCGKVYGKASHLKAHLRWHTGERPFVCNWLFCGKRFTRSDELERHVRTHTREKKFTCLLCSKRFTRSDHLSKHQRTHGEPGPGPPPSGPKELGEGRSTGEEEASQTPRPSASPATPEKAPGGSPEQSNLLEI

SEQ ID NO: 65021 - protein, 466 aa, Homo sapiens [sequence omitted]

SEQ ID NO: 65022 - protein, 490 aa, Homo sapiens
MLAATCNKIGSPSPSPSSLSDSSSSFGKGFHPWKRSSSSSSASCNVVGSSLSSFGVSGASRNGGSSSAAAAAAAAAAAAAALVSDSFSCGGSPGSSAFSLTSSSAAAAAAAAAAAASSSPFANDYSVFQAPGVSGGSGGGGGGGGGGSSAHSQDGSHQPVFISKVHTSVDGLQGIYPRVGMAHPYESWFKPSHPGLGAAGEVGSAGASSWWDVGAGWIDVQNPNSAAALPGSLHPAAGGLQTSLHSPLGGYNSDYSGLSHSAFSSGASSHLLSPAGQHLMDGFKPVLPGSYPDSAPSPLAGAGGSMLSAGPSAPLGGSPRSSARRYSGRATCDCPNCQEAERLGPAGASLRRKGLHSCHIPGCGKVYGKTSHLKAHLRWHTGERPFVCNWLFCGKRFTRSDELQRHLRTHTGEKRFACPVCNKRFMRSDHLSKHVKTHSGGGGGGGSAGSGSGGKKGSDTDSEHSAAGSPPCHSPELLQPPEPGHRNGLE

SEQ ID NO: 65023 - protein, 508 aa, Homo sapiens
MATSLLGEEPRLGSTPLAMLAATCNKIGSPSPSPSSLSDSSSSFGKGFHPWKRSSSSSSASCNVVGSSLSSFGVSGASRNGGSSSAAAAAAAAAAAAAALVSDSFSCGGSPGSSAFSLTSSSAAAAAAAAAAAASSSPFANDYSVFQAPGVSGGSGGGGGGGGGGSSAHSQDGSHQPVFISKVHTSVDGLQGIYPRVGMAHPYESWFKPSHPGLGAAGEVGSAGASSWWDVGAGWIDVQNPNSAAALPGSLHPAAGGLQTSLHSPLGGYNSDYSGLSHSAFSSGASSHLLSPAGQHLMDGFKPVLPGSYPDSAPSPLAGAGGSMLSAGPSAPLGGSPRSSARRYSGRATCDCPNCQEAERLGPAGASLRRKGLHSCHIPGCGKVYGKTSHLKAHLRWHTGERPFVCNWLFCGKRFTRSDELQRHLRTHTGEKRFACPVCNKRFMRSDHLSKHVKTHSGGGGGGGSAGSGSGGKKGSDTDSEHSAAGSPPCHSPELLQPPEPGHRNGLE

SEQ ID NO: 65024 - protein, 97 aa, Homo sapiens
MDKQSSAGGVKRSVPCDSNEANEMMPETPTGDSDPQPAPKKMKTSESSTILVVRYRRNFKRTSPEELLNDHARENRINPLQMEEEEFMEIMVEIPAK

SEQ ID NO: 65025 - protein, 97 aa, Homo sapiens
MDKQSSAGGVKRSVPCESNEVNETMPETPTGDSDPQPAPKKMKTSESSTILVVRYRRNVKRTSPEELLNDHARENRINPLQMEEEEFMEIMVEIPAK

SEQ ID NO: 65026 - protein, 435 aa, Homo sapiens
MLPARCARLLTPHLLLVLVQLSPARGHRTTGPRFLISDRDPQCNLHCSRTQPKPICASDGRSYESMCEYQRAKCRDPTLGVVHRGRCKDAGQSKCRLERAQALEQAKKPQEAVFVPECGEDGSFTQVQCHTYTGYCWCVTPDGKPISGSSVQNKTPVCSGSVTDKPLSQGNSGRKDDGSKPTPTMETQPVFDGDEITAPTLWIKHLVIKDSKLNNTNIRNSEKVYSCDQERQSALEEAQQNPREGIVIPECAPGGLYKPVQCHQSTGYCWCVLVDTGRPLPGTSTRYVMPSCESDARAKTTEADDPFKDRELPGCPEGKKMEFITSLLDALTTDMVQAINSAAPTGGGRFSEPDPSHTLEERVVHWYFSQLDSNSSNDINKREMKPFKRYVKKKAKPKKCARRFTDYCDLNKDKVISLPELKGCLGVSKEVGRLV

SEQ ID NO: 65027 - protein, 434 aa, Homo sapiens
MLPARCARLLTPHLLLVLVQLSPARGHRTTGPRFLISDRDPQCNLHCSRTQPKPICASDGRSYESMCEYQRAKCRDPTLGVVHRGRCKDAGQSKCRLERAQALEQAKKPQEAVFVPECGEDGSFTQVQCHTYTGYCWCVTPDGKPISGSSVQNKTPVCSGSVTDKPLSQGNSGRKDDGSKPTPTMETQPVFDGDEITAPTLWIKHLVIKDSKLNNTNIRNSEKVYSCDQERQSALEEAQQNPREGIVIPECAPGGLYKPVQCHQSTGYCWCVLVDTGRPLPGTSTRYVMPSCESDARAKTTEADDPFKDRELPGCPEGKKMEFITSLLDALTTDMVQAINSAAPTGGGRFSEPDPSHTLEERVVHWYFSQLDSNSSNDINKREMKPFKRYVKKKAKPKKCARRFTDYCDLNKDKVISLPELKGCLGVSKEGRLV

SEQ ID NO: 65028 - protein, 457 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTVSLQIFSVLNSDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 65029 - protein, 446 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 65030 - protein, 448 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQENPRKEG

SEQ ID NO: 65031 - protein, 84 aa, Homo sapiens
KKSKPKKCVKKFVEYCDVNNDKSISVQELMGCLGVAKEDGKADTKKRHTPRGHAESTSNRQDAMVVSSRPKATTHRKSRTLSRR

SEQ ID NO: 65032 - protein, 424 aa, Homo sapiens
MRAPGCGRLVLPLLLLAAAALAEGDAKGLKEGETPGNFMEDEQWLSSISQYSGKIKHWNRFRDEVEDDYIKSWEDNQQGDEALDTTKDPCQKVKCSRHKVCIAQGYQRAMCISRKKLEHRIKQPTVKLHGNKDSICKPCHMAQLASVCGSDGHTYSSVCKLEQQACLSSKQLAVRCEGPCPCPTEQAATSTADGKPETCTGQDLADLGDRLRDWFQLLHENSKQNGSASSVAGPASGLDKSLGASCKDSIGWMFSKLDTSADLFLDQTELAAINLDKYEVCIRPFFNSCDTYKDGRVSTAEWCFCFWREKPPCLAELERIQIQEAAKKKPGIFIPSCDEDGYYRKMQCDQSSGDCWCVDQLGLELTGTRTHGSPDCDDIVGFSGDFGSGVGWEDEEEKETEEAGEEAEEEEGEAGEADDGGYIW

SEQ ID NO: 65033 - protein, 421 aa, Homo sapiens
MRAPGCGRLVLPLLLLAAAALAEGDAKGLKEGETPGNFMEDEQWLSSISQYSGKIKHWNRFRDDDYIKSWEDNQQGDEALDTTKDPCQKVKCSRHKVCIAQGYQRAMCISRKKLEHRIKQPTVKLHGNKDSICKPCHMAQLASVCGSDGHTYSSVCKLEQQACLSSKQLAVRCEGPCPCPTEQAATSTADGKPETCTGQDLADLGDRLRDWFQLLHENSKQNGSASSVAGPASGLDKSLGASCKDSIGWMFSKLDTSADLFLDQTELAAINLDKYEVCIRPFFNSCDTYKDGRVSTAEWCFCFWREKPPCLAELERIQIQEAAKKKPGIFIPSCDEDGYYRKMQCDQSSGDCWCVDQLGLELTGTRTHGSPDCDDIVGFSGDFGSGVGWEDEEEKETEEAGEEAEEEEGEAGEADDGGYIW

SEQ ID NO: 65034 - protein, 77 aa, Homo sapiens
MRAPGCGRLVLPLLLLAAAALAEGDAKGLKEGETPGNFMEDEQWLSSISQYSGKIKHWNRFRDVPSSDPPSTTQATP

SEQ ID NO: 65035 - protein, 424 aa, Homo sapiens
MRAPGCGRLVLPLLLLAAAALAEGDAKGLKEGETPGNFMEDEQWLSSISQYSGKIKHWNRFRDGIEDDYIKSWEDNQQGDEALDTTKDPCQKVKCSRHKVCIAQGYQRAMCISRKKLEHRIKQPTVKLHGNKDSICKPCHMAQLASVCGSDGHTYSSVCKLEQQACLSSKQLAVRCEGPCPCPTEQAATSTADGKPETCTGQDLADLGDRLRDWFQLLHENSKQNGSASSVAGPASGLDKSLGASCKDSIGWMFSKLDTSADLFLDQTELAAINLDKYEVCIRPFFNSCDTYKDGRVSTAEWCFCFWREKPPCLAELERIQIQEAAKKKPGIFIPSCDEDGYYRKMQCDQSSGDCWCVDQLGLELTGTRTHGSPDCDDIVGFSGDFGSGVGWEDEEEKETEEAGEEAEEEEGEAGEADDGGYIW

SEQ ID NO: 65036 - protein, 436 aa, Homo sapiens
MLKVSAVLCVCAAAWCSQSLAAAAAVAAAGGRSDGGNFLDDKQWLTTISQYDKEVGQWNKFRDEVEDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 65037 - protein, 433 aa, Homo sapiens
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 65038 - protein, 385 aa, Homo sapiens
MITQDHIHMSSGLSQDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 65039 - protein, 436 aa, Homo sapiens; identical to SEQ ID NO: 65036

SEQ ID NO: 65040 - protein, 433 aa, Homo sapiens; identical to SEQ ID NO: 65037

SEQ ID NO: 65041 - protein, 115 aa, Homo sapiens
MLKVSAVLCVCAAAWCSQSLAAAAAVAAAGGRSDGGNFLDDKQWLTTISQYDKEVGQWNKFRDEVEDDYFRTWSPGKPFDQALDPAKDPCLKMKCSRHKVCIAQDSQTAVCISHR

SEQ ID NO: 65042 - protein, 436 aa, Homo sapiens; identical to SEQ ID NO: 65036

SEQ ID NO: 65043 - protein, 161 aa, Homo sapiens
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKL

SEQ ID NO: 65044 - protein, 173 aa, Homo sapiens [sequence omitted]

SEQ ID NO: 65045 - protein, 393 aa, Homo sapiens
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRGFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 65046 - protein, 433 aa, Homo sapiens; identical to SEQ ID NO: 65037

SEQ ID NO: 65047 - protein, 436 aa, Homo sapiens; identical to SEQ ID NO: 65036

SEQ ID NO: 65048 - protein, 115 aa, Homo sapiens; identical to SEQ ID NO: 65041

SEQ ID NO: 65049 - protein, 313 aa, Homo sapiens
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQGKR

SEQ ID NO: 65050 - protein, 338 aa, Homo sapiens
MLKVSAVLCVCAAAWCSQSLAAAAAVAAAGGRSDGGNFLDDKQWLTTISQYDKEVGQWNKFRDCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 65051 - protein, 340 aa, Homo sapiens
MINNGSPQSLSMTRKSDSGTNSETMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 65052 - protein, 304 aa, Homo sapiens
MKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRGFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 65053 - protein, 316 aa, Homo sapiens
MKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 65054 - protein, 338 aa, Homo sapiens; identical to SEQ ID NO: 65050

SEQ ID NO: 65055 - protein, 4579 aa, Homo sapiens
METKENRWVPVTVLPGCVGCRTVAALASWTVRDVKERIFAETGFPVSEQRLWRGGRELSDWIKIGDLTSKNCHLFVNLQSKGLKGGGRFGQTTPPLVDFLKDILRRYPEGGQILKELIQNAEDAGATEVKFLYDETQYGTETLWSKDMAPYQGPALYVYNNAVFTPEDWHGIQEIARSRKKDDPLKVGRFGIGFNSVYHITDVPCIFSGDQIGMLDPHQTLFGPHESGQCWNLKDDSKEISELSDQFAPFVGIFGSTKETFINGNFPGTFFRFPLRLQPSQLSSNLYNKQKVLELFESFRADADTVLLFLKSVQDVSLYVREADGTEKLVFRVTSSESKALKHERPNSIKILGTAISNYCKKTPSNNITCVTYHVNIVLEEESTKDAQKTSWLVCNSVGGRGISSKLDSLADELKFVPIIGIAMPLSSRDDEAKGATSDFSGKAFCFLPLPPGEESSTGLPVHISGFFGLTDNRRSIKWRELDQWRDPAALWNEFLVMNVVPKAYATLILDSIKRLEMEKSSDFPLSVDVIYKLWPEASKVKVHWQPVLEPLFSELLQNAVIYSISCDWVRLEQVYFSELDENLEYTKTVLNYLQSSGKQIAKVPGNVDAAVQLTAASGTTPVRKVTPAWVRQVLRKCAHLGCAEEKLHLLEFVLSDQAYSELLGLELLPLQNGNFVPFSSSVSDQDVIYITSAEYPRSLFPSLEGRFILDNLKPHLVAALKEAAQTRGRPCTQLQLLNPERFARLIKEVMNTFWPGRELIVQWYPFDENRNHPSVSWLKMVWKNLYIHFSEDLTLFDEMPLIPRTILEEGQTCVELIRLRIPSLVILDDESEAQLPEFLADIVQKLGGFVLKKLDASIQHPLIKKYIHSPLPSAVLQIMEKMPLQKLCNQITSLLPTHKDALRKFLASLTDSSEKEKRIIQELAIFKRINHSSDQGISSYTKLKGCKVLHHTAKLPADLRLSISVIDSSDEATIRLANMLKIEQLKTTSCLKLVLKDIENAFYSHEEVTQLMLWVLENLSSLKNENPNVLEWLTPLKFIQISQEQMVSAGELFDPDIEVLKDLFCNEEGTYFPPSVFTSPDILHSLRQIGLKNEASLKEKDVVQVAKKIEALQVGACPDQDVLLKKAKTLLLVLNKNHTLLQSSEGKMTLKKIKWVPACKERPPNYPGSLVWKGDLCNLCAPPDMCDVGHAILIGSSLPLVESIHVNLEKALGIFTKPSLSAVLKHFKIVVDWYSSKTFSDEDYYQFQHILLEIYGFMHDHLNEGKDSFRALKFPWVWTGKKFCPLAQAVIKPIHDLDLQPYLHNVPKTMAKFHQLFKVCGSIEELTSDHISMVIQKIYLKSDQDLSEQESKQNLHLMLNIIRWLYSNQIPASPNTPVPIHHSKNPSKLIMKPIHECCYCDIKVDDLNDLLEDSVEPIILVHEDIPMKTAEWLKVPCLSTRLINPENMGFEQSGQREPLTVRIKNILEEYPSVSDIFKELLQNADDANATECSFLIDMRRNMDIRENLLDPGMAACHGPALWSFNNSQFSDSDFVNITRLGESLKRGEVDKVGKFGLGFNSVYHITDIPIIMSREFMIMFDPNINHISKHIKDKSNPGIKINWSKQQKRLRKFPNQFKPFIDVFGCQLPLTVEAPYSYNGTLFRLSFRTQQEAKVSEVSSTCYNTADIYSLVDEFSLCGHRLIIFTQSVKSMYLKYLKIEETNPSLAQDTVIIKKKSCSSKALNTPVLSVLKEAAKLMKTCSSSNKKLPSDEPKSSCILQITVEEFHHVFRRIADLQSPLFRGPDDDPAALFEMAKSGQSKKPSDELSQKTVECTTWLLCTCMDTGEALKFSLSESGRRLGLVPCGAVGVQLSEIQDQKWTVKPHIGEVFCYLPLRIKTGLPVHINGCFAVTSNRKEIWKTDTKGRWNTTFMRHVIVKAYLQVLSVLRDLATSGELMDYTYYAVWPDPDLVHDDFSVICQGFYEDIAHGKGKELTKVFSDGSTWVSMKNVRFLDDSILKRRDVGSAAFKIFLKYLKKTGSKNLCAVELPSSVKLGFEEAGCKQILLENTFSEKQFFSEVFFPNIQEIEAELRDPLMIFVLNEKVDEFSGVLRVTPCIPCSLEGHPLVLPSRLIHPEGRVAKLFDIKDGRFPYGSTQDYLNPIILIKLVQLGMAKDDILWDDMLERAVSVAEINKSDHVAACLRSSILLSLIDEKLKIRDPRAKDFAAKYQTIRFLPFLTKPAGFSLDWKGNSFKPETMFAATDLYTAEHQDIVCLLQPILNENSHSFRGCGSVSLAVKEFLGLLKKPTVDLVINQLKEVAKSVDDGITLYQENITNACYKYLHEALMQNEITKMSIIDKLKPFSFILVENAYVDSEKVSFHLNFEAAPYLYQLPNKYKNNFRELFETVGVRQSCTVEDFALVLESIDQERGTKQITEENFQLCRRIISEGIWSLIREKKQEFCEKNYGKILLPDTNLMLLPAKSLCYNDCPWIKVKDTTVKYCHADIPREVAVKLGAVPKRHKALERYASNVCFTTLGTEFGQKEKLTSRIKSILNAYPSEKEMLKELLQNADDAKATEICFVFDPRQHPVDRIFDDKWAPLQGPALCVYNNQPFTEDDVRGIQNLGKGTKEGNPYKTGQYGIGFNSVYHITDCPSFISGNDILCIFDPHARYAPGATSISPGRMFRDLDADFRTQFSDVLDLYLGTHFKLDNCTMFRFPLRNAEMAKVSEISSVPASDRMVQNLLDKLRSDGAELLMFLNHMEKISICEIDKSTGALNVLYSVKGKITDGDRLKRKQFHASVIDSVTKKRQLKDIPVQQITYTMDTEDSEGNLTTWLICNRSGFSSMEKVSKSVISAHKNQDITLFPRGGVAACITHNYKKPHRAFCFLPLSLETGLPFHVNGHFALDSARRNLWRDDNGVGVRSDWNNSLMTALIAPAYVELLIQLKKRYFPGSDPTLSVLQNTPIHVVKDTLKKFLSFFPVNRLDLQPDLYCLVKALYNCIHEDMKRLLPVVRAPNIDGSDLHSAVIITWINMSTSNKTRPFFDNLLQDELQHLKNADYNITTRKTVAENVYRLKHLLLEIGFNLVYNCDETANLYHCLIDADIPVSYVTPADIRSFLMTFSSPDTNCHIGKLPCRLQQTNLKLFHSLKLLVDYCFKDAEENEIEVEGLPLLITLDSVLQTFDAKRPKFLTTYHELIPSRKDLFMNTLYLKYSNILLNCKVAKVFDISSFADLLSSVLPREYKTKSCTKWKDNFASESWLKNAWHFISESVSVKEDQEETKPTFDIVVDTLKDWALLPGTKFTVSANQLVVPEGDVLLPLSLMHIAVFPNAQSDKVFHALMKAGCIQLALNKICSKDSAFVPLLSCHTANIESPTSILKALHYMVQTSTFRAEKLVENDFEALLMYFNCNLNHLMSQDDIKILKSLPCYKSISGRYVSIGKFGTCYVLTKSIPSAEVEKWTQSSSSAFLEEKIHLKELYEVIGCVPVDDLEVYLKHLLPKIENLSYDAKLEHLIYLKNRLSSAEELSEIKEQLFEKLESLLIIHDANSRLKQAKHFYDRTVRVFEVMLPEKLFIPNDFFKKLEQLIKPKNHVTFMTSWVEFLRNIGLKYILSQQQLLQFAKEISVRANTENWSKETLQNTVDILLHHIFQERMDLLSGNFLKELSLIPFLCPERAPAEFIRFHPQYQEVNGTLPLIKFNGAQVNPKFKQCDVLQLLWTSCPILPEKATPLSIKEQEGSDLGPQEQLEQVLNMLNVNLDPPLDKVINNCRNICNITTLDEEMVKTRAKVLRSIYEFLSAEKREFRFQLRGVAFVMVEDGWKLLKPEEVVINLEYESDFKPYLYKLPLELGTFHQLFKHLGTEDIISTKQYVEVLSRIFKNSEGKQLDPNEMRTVKRVVSGLFRSLQNDSVKVRSDLENVRDLALYLPSQDGRLVKSSILVFDDAPHYKSRIQGNIGVQMLVDLSQCYLGKDHGFHTKLIMLFPQKLRPRLLSSILEEQLDEETPKVCQFGALCSLQGRLQLLLSSEQFITGLIRIMKHENDNAFLANEEKAIRLCKALREGLKVSCFEKLQTTLRVKGFNPIPHSRSETFAFLKRFGNAVILLYIQHSDSKDINFLLALAMTLKSATDNLISDTSYLIAMLGCNDIYRIGEKLDSLGVKYDSSEPSKLELPMPGTPIPAEIHYTLLMDPMNVFYPGEYVGYLVDAEGGDIYGSYQPTYTYAIIVQEVEREDADNSSFLGKIYQIDIGYSEYKIVSSLDLYKFSRPEESSQSRDSAPSTPTSPTEFLTPGLRSIPPLFSGRESHKTSSKHQSPKKLKVNSLPEILKEVTSVVEQAWKLPESERKKIIRRLYLKWHPDKNPENHDIANEVFKHLQNEINRLEKQAFLDQNADRASRRTFSTSASRFQSDKYSFQRFYTSWNQEATSHKSERQQQNKEKCPPSAGQTYSQRFFVPPTFKSVGNPVEARRWLRQARANFSAARNDLHKNANEWVCFKCYLSTKLALIAADYAVRGKSDKDVKPTALAQKIEEYSQQLEGLTNDVHTLEAYGVDSLKTRYPDLLPFPQIPNDRFTSEVAMRVMECTACIIIKLENFMQQKV

SEQ ID NO: 65056 - protein, 4579 aa, Homo sapiens; identical to SEQ ID NO: 65055

SEQ ID NO: 65057 - protein, 3829 aa, Homo sapiens
MNTFWPGRELIVQWYPFDENRNHPSVSWLKMVWKNLYIHFSEDLTLFDEMPLIPRTILEEGQTCVELIRLRIPSLVILDDESEAQLPEFLADIVQKLGGFVLKKLDASIQHPLIKKYIHSPLPSAVLQIMEKMPLQKLCNQITSLLPTHKDALRKFLASLTDSSEKEKRIIQELAIFKRINHSSDQGISSYTKLKGCKVLHHTAKLPADLRLSISVIDSSDEATIRLANMLKIEQLKTTSCLKLVLKDIENAFYSHEEVTQLMLWVLENLSSLKNENPNVLEWLTPLKFIQISQEQMVSAGELFDPDIEVLKDLFCNEEGTYFPPSVFTSPDILHSLRQIGLKNEASLKEKDVVQVAKKIEALQVGACPDQDVLLKKAKTLLLVLNKNHTLLQSSEGKMTLKKIKWVPACKERPPNYPGSLVWKGDLCNLCAPPDMCDVGHAILIGSSLPLVESIHVNLEKALGIFTKPSLSAVLKHFKIVVDWYSSKTFSDEDYYQFQHILLEIYGFMHDHLNEGKDSFRALKFPWVWTGKKFCPLAQAVIKPIHDLDLQPYLHNVPKTMAKFHQLFKVCGSIEELTSDHISMVIQKIYLKSDQDLSEQESKQNLHLMLNIIRWLYSNQIPASPNTPVPIHHSKNPSKLIMKPIHECCYCDIKVDDLNDLLEDSVEPIILVHEDIPMKTAEWLKVPCLSTRLINPENMGFEQSGQREPLTVRIKNILEEYPSVSDIFKELLQNADDANATECSFLIDMRRNMDIRENLLDPGMAACHGPALWSFNNSQFSDSDFVNITRLGESLKRGEVDKVGKFGLGFNSVYHITDIPIIMSREFMIMFDPNINHISKHIKDKSNPGIKINWSKQQKRLRKFPNQFKPFIDVFGCQLPLTVEAPYSYNGTLFRLSFRTQQEAKVSEVSSTCYNTADIYSLVDEFSLCGHRLIIFTQSVKSMYLKYLKIEETNPSLAQDTVIIKKKSCSSKALNTPVLSVLKEAAKLMKTCSSSNKKLPSDEPKSSCILQITVEEFHHVFRRIADLQSPLFRGPDDDPAALFEMAKSGQSKKPSDELSQKTVECTTWLLCTCMDTGEALKFSLSESGRRLGLVPCGAVGVQLSEIQDQKWTVKPHIGEVFCYLPLRIKTGLPVHINGCFAVTSNRKEIWKTDTKGRWNTTFMRHVIVKAYLQVLSVLRDLATSGELMDYTYYAVWPDPDLVHDDFSVICQGFYEDIAHGKGKELTKVFSDGSTWVSMKNVRFLDDSILKRRDVGSAAFKIFLKYLKKTGSKNLCAVELPSSVKLGFEEAGCKQILLENTFSEKQFFSEVFFPNIQEIEAELRDPLMIFVLNEKVDEFSGVLRVTPCIPCSLEGHPLVLPSRLIHPEGRVAKLFDIKDGRFPYGSTQDYLNPIILIKLVQLGMAKDDILWDDMLERAVSVAEINKSDHVAACLRSSILLSLIDEKLKIRDPRAKDFAAKYQTIRFLPFLTKPAGFSLDWKGNSFKPETMFAATDLYTAEHQDIVCLLQPILNENSHSFRGCGSVSLAVKEFLGLLKKPTVDLVINQLKEVAKSVDDGITLYQENITNACYKYLHEALMQNEITKMSIIDKLKPFSFILVENAYVDSEKVSFHLNFEAAPYLYQLPNKYKNNFRELFETVGVRQSCTVEDFALVLESIDQERGTKQITEENFQLCRRIISEGIWSLIREKKQEFCEKNYGKILLPDTNLMLLPAKSLCYNDCPWIKVKDTTVKYCHADIPREVAVKLGAVPKRHKALERYASNVCFTTLGTEFGQKEKLTSRIKSILNAYPSEKEMLKELLQNADDAKATEICFVFDPRQHPVDRIFDDKWAPLQGPALCVYNNQPFTEDDVRGIQNLGKGTKEGNPYKTGQYGIGFNSVYHITDCPSFISGNDILCIFDPHARYAPGATSISPGRMFRDLDADFRTQFSDVLDLYLGTHFKLDNCTMFRFPLRNAEMAKVSEISSVPASDRMVQNLLDKLRSDGAELLMFLNHMEKISICEIDKSTGALNVLYSVKGKITDGDRLKRKQFHASVIDSVTKKRQLKDIPVQQITYTMDTEDSEGNLTTWLICNRSGFSSMEKVSKSVISAHKNQDITLFPRGGVAACITHNYKKPHRAFCFLPLSLETGLPFHVNGHFALDSARRNLWRDDNGVGVRSDWNNSLMTALIAPAYVELLIQLKKRYFPGSDPTLSVLQNTPIHVVKDTLKKFLSFFPVNRLDLQPDLYCLVKALYNCIHEDMKRLLPVVRAPNIDGSDLHSAVIITWINMSTSNKTRPFFDNLLQDELQHLKNADYNITTRKTVAENVYRLKHLLLEIGFNLVYNCDETANLYHCLIDADIPVSYVTPADIRSFLMTFSSPDTNCHIGKLPCRLQQTNLKLFHSLKLLVDYCFKDAEENEIEVEGLPLLITLDSVLQTFDAKRPKFLTTYHELIPSRKDLFMNTLYLKYSNILLNCKVAKVFDISSFADLLSSVLPREYKTKSCTKWKDNFASESWLKNAWHFISESVSVKEDQEETKPTFDIVVDTLKDWALLPGTKFTVSANQLVVPEGDVLLPLSLMHIAVFPNAQSDKVFHALMKAGCIQLALNKICSKDSAFVPLLSCHTANIESPTSILKALHYMVQTSTFRAEKLVENDFEALLMYFNCNLNHLMSQDDIKILKSLPCYKSISGRYVSIGKFGTCYVLTKSIPSAEVEKWTQSSSSAFLEEKIHLKELYEVIGCVPVDDLEVYLKHLLPKIENLSYDAKLEHLIYLKNRLSSAEELSEIKEQLFEKLESLLIIHDANSRLKQAKHFYDRTVRVFEVMLPEKLFIPNDFFKKLEQLIKPKNHVTFMTSWVEFLRNIGLKYILSQQQLLQFAKEISVRANTENWSKETLQNTVDILLHHIFQERMDLLSGNFLKELSLIPFLCPERAPAEFIRFHPQYQEVNGTLPLIKFNGAQVNPKFKQCDVLQLLWTSCPILPEKATPLSIKEQEGSDLGPQEQLEQVLNMLNVNLDPPLDKVINNCRNICNITTLDEEMVKTRAKVLRSIYEFLSAEKREFRFQLRGVAFVMVEDGWKLLKPEEVVINLEYESDFKPYLYKLPLELGTFHQLFKHLGTEDIISTKQYVEVLSRIFKNSEGKQLDPNEMRTVKRVVSGLFRSLQNDSVKVRSDLENVRDLALYLPSQDGRLVKSSILVFDDAPHYKSRIQGNIGVQMLVDLSQCYLGKDHGFHTKLIMLFPQKLRPRLLSSILEEQLDEETPKVCQFGALCSLQGRLQLLLSSEQFITGLIRIMKHENDNAFLANEEKAIRLCKALREGLKVSCFEKLQTTLRVKGFNPIPHSRSETFAFLKRFGNAVILLYIQHSDSKDINFLLALAMTLKSATDNLISDTSYLIAMLGCNDIYRIGEKLDSLGVKYDSSEPSKLELPMPGTPIPAEIHYTLLMDPMNVFYPGEYVGYLVDAEGGDIYGSYQPTYTYAIIVQEVEREDADNSSFLGKIYQIDIGYSEYKIVSSLDLYKFSRPEESSQSRDSAPSTPTSPTEFLTPGLRSIPPLFSGRESHKTSSKHQSPKKLKVNSLPEILKEVTSVVEQAWKLPESERKKIIRRLYLKWHPDKNPENHDIANEVFKHLQNEINRLEKQAFLDQNADRASRRTFSTSASRFQSDKYSFQRFYTSWNQEATSHKSERQQQNKEKCPPSAGQTYSQRFFVPPTFKSVGNPVEARRWLRQARANFSAARNDLHKNANEWVCFKCYLSTKLALIAADYAVRGKSDKDVKPTALAQKIEEYSQQLEGLTNDVHTLEAYGVDSLKTRYPDLLPFPQIPNDRFTSEVAMRVMECTACIIIKLENFMQQKV

SEQ ID NO: 65058 - protein, 2443 aa, Homo sapiens
MAAEEGVASAASAGGSWGTAAMGRVLPMLLVPVPAEAMGQLGSRAQLRTQPEALGSLTAAGSLQVLSLTPGSRGGGRCCLEGPFWHFLWEDSRNSSTPTEKPKLLALGENYELLIYEFNLKDGRCDATILYSCSREALQKLIDDQDISISLLSLRILSFHNNTSLLFINKCVILHIIFPERDAAIRVLNCFTLPLPAQAVDMIIDTQLCRGILFVLSSLGWIYIFDVVDGTYVAHVDLALHKEDMCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSILERLQTDGQFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 65059 - protein, 2330 aa, Homo sapiens
MAAEEGVASAASAGGSWGTAAMGRVLPMLLVPVPAEAMGQLGSRAQLRTQPEALGSLTAAGSLQVLSLTPGSRGGGRCCLEGPFWHFLWEDSRNSSTPTEKPKLLALGENYELLIYEFNLKDGRCDATILYSCSREALQKLIDDQDISISLLSLRILSFHNNTSLLFINKCVILHIIFPERDAAIRVLNCFTLPLPAQAVDMIIDTQLCRGILFVLSSLGWIYIFDVVDGTYVAHVDLALHKEDMCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSILERLQTDGQFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSRHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 65060 - protein, 2079 aa, Homo sapiens
MAAEEGVASAASAGGSWGTAAMGRVLPMLLVPVPAEAMGQLGSRAQLRTQPEALGSLTAAGSLQVLSLTPGSRGGGRCCLEGPFWHFLWEDSRNSSTPTEKPKLLALGENYELLIYEFNLKDGRCDATILYSCSREALQKLIDDQDISISLLSLRILSFHNNTSLLFINKCVILHIIFPERDAAIRVLNCFTLPLPAQAVDMIIDTQLCRGILFVLSSLGWIYIFDVVDGTYVAHVDLALHKEDMCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSILERLQTDGQFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGALPPGDSQPL

SEQ ID NO: 65061 - protein, 666 aa, Homo sapiens
MEQEPQNGEPAEIKIIREAYKKAFLFVNKGLNTDELGQKEEAKNYYKQGIGHLLRGISISSKESEHTGPGWESARQMQQKMKETLQNVRTRLEILEKGLATSLQNDLQEVPKLYPEFPPKDMCEKLPEPQSFSSAPQHAEVNGNTSTPSAGAVAAPASLSLPSQSCPAEAPPAYTPQAAEGHYTVSYGTDSGEFSSVGEEFYRNHSQPPPLETLGLDADELILIPNGVQIFFVNPAGEVSAPSYPGYLRIVRFLDNSLDTVLNRPPGFLQVCDWLYPLVPDRSPVLKCTAGAYMFPDTMLQAAGCFVGVVLSSELPEDDRELFEDLLRQMSDLRLQANWNRAEEENEFQIPGRTRPSSDQLKEASGTDVKQLDQGNKDVRHKGKRGKRAKDTSSEEVNLSHIVPCEPVPEEKPKELPEWSEKVAHNILSGASWVSWGLVKGAEITGKAIQKGASKLRERIQPEEKPVEVSPAVTKGLYIAKQATGGAAKVSQFLVDGVCTVANCVGKELAPHVKKHGSKLVPESLKKDKDGKSPLDGAMVVAASSVQGFSTVWQGLECAAKCIVNNVSAETVQTVRYKYGYNAGEATHHAVDSAVNVGVTAYNINNIGIKAMVKKTATQTGHTLLEDYQIVDNSQRENQEGAANVNVRGEKDEQTKEVKEAKKKDK

SEQ ID NO: 65062 - protein, 666 aa, Homo sapiens; identical to SEQ ID NO: 65061

SEQ ID NO: 65063 - protein, 666 aa, Homo sapiens; identical to SEQ ID NO: 65061

SEQ ID NO: 65064 - protein, 666 aa, Homo sapiens; identical to SEQ ID NO: 65061

SEQ ID NO: 65065 - protein, 281 aa, Homo sapiens
MGEIKVSPDYNWFRGTVPLKKIIVDDDDSKIWSLYDAGPRSIRCPLIFLPPVSGTADVFFRQILALTGWGYRVIAVHLFGASLGGFLAQKFAEYTHKSPRVHSLILCNSFSDTSIFNQTWTANSFWLMPAFMLKKIVLGNFSSGPVDPMMADAIDFMVDRLESLGQSELASRLTLNCQNSYVEPHKIRDIPVTIMDVFDQSALSTEAKEEMYKLYPNARRAHLKTGGNFPYLCRSAEVNLYVQIHLLQFHGTKYAAIDPSMVSAEELEVQKGSLGISQEEQ

SEQ ID NO: 65066 - protein, 308 aa, Homo sapiens
MGEIKVSPDYNWFRGTVPLKKIIVDDDDSKIWSLYDAGPRSIRCPLIFLPPVSGTADVFFRQILALTGWGYRVIALQYPVYWDHLEFCDGFRKLLDHLQLDKVHLFGASLGGFLAQKFAEYTHKSPRVHSLILCNSFSDTSIFNQTWTANSFWLMPAFMLKKIVLGNFSSGPVDPMMADAIDFMVDRLESLGQSELASRLTLNCQNSYVEPHKIRDIPVTIMDVFDQSALSTEAKEEMYKLYPNARRAHLKTGGNFPYLCRSAEVNLYVQIHLLQFHGTKYAAIDPSMVSAEELEVQKGSLGISQEEQ

SEQ ID NO: 65067 - protein, 308 aa, Homo sapiens; identical to SEQ ID NO: 65066

SEQ ID NO: 65068 - protein, 795 aa, Homo sapiens
MAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGMGTTDHVIVLASTNRADILDGALMRPGRLDRHVFIDLPTLQERREIFEQHLKSLKLTQSSTFYSQRLAELTPGFSGADIANICNEAALHAAREGHTSVHTLNFEYAVERVLAGTAKKSKILSKEEQKVVAFHESGHALVGWMLEHTEAVMKVSITPRTNAALGFAQMLPRDQHLFTKEQLFERMCMALGGRASEALSFNEVTSGAQDDLRKVTRIAYSMVKQFGMAPGIGPISFPEAQEGLMGIGRRPFSQGLQQMMDHEARLLVAKAYRHTEKVLQDNLDKLQALANALLEKEVINYEDIEALIGPPPHGPKKMIAPQRWIDAQREKQDLGEEETEETQQPPLGGEEPTWPK

SEQ ID NO: 65069 - protein, 223 aa, Homo sapiens
MRLRCTRRGRDTLPCTLSTSSTPWSASSQVPRAQLGKAVGSCRGVGSCCARHCKTHLASLRQPCGERTGAACVLLIYFRVTIYFYVEIEKLLIIVAKQEGLSGNHKPVERKYMTYLSAQDHELIQVVQNGHLQMCGKSETGNEASPGLPKRARSCPRKNRKWLRFMSRATPWWAGCWSTRRDEGLHNPSTNAALGFAQAPQRPAPLHEQLFERMCMALGGRAS

SEQ ID NO: 65070 - protein, 205 aa, Homo sapiens
LGPQACTVVPRSKCFDLEMVSSRWEPLLLLTEVTSANEVWVTSNSTALVFVSDNVREELEEVQDLLCRTLPLPVQLSFPEEALDVARVAHVFVSPFCFSAGSEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRA

SEQ ID NO: 65071 - protein, 489 aa, Homo sapiens
MAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGASLDQLPSQGTMRKLRGKTPACSCLTEPTGSRRAMEGHSLCWGCLLH

SEQ ID NO: 65072 - protein, 616 aa, Homo sapiens
MNSPGGRGKKKGSGGASNPVPPRPPPPCLAPAPPAAGPAPPPESPHKRNLYYFSYPLFVGFALLRLVAFHLGLLFVWLCQRFSRALMAAKRSSGAAPAPASASAPAPVPGGEAERVRVFHKQAFEYISIALRIDEDEKAGQKEQAVEWYKKGIEELEKGIAVIVTGQGEQCERARRLQAKMMTNLVMAKDRLQLLEKMQPVLPFSKSQTDVYNDSTNLACRNGHLQSESGAVPKRKDPLTHTSNSLPRSKTVMKTGSAGLSGHHRAPSYSGLSMVSGVKQGSGPAPTTHKGTPKTNRTNKPSTPTTATRKKKDLKNFRNVDSNLANLIMNEIVDNGTAVKFDDIAGQDLAKQALQEIVILPSLRPELFTGLRAPARGLLLFGPPGNGKTMLAKAVAAESNATFFNISAASLTSKYVGEGEKLVRALFAVARELQPSIIFIDEVDSLLCERREGEHDASRRLKTEFLIEFDGVQSAGDDRVLVMGATNRPQELDEAVLRRFIKRVYVSLPNEETRLLLLKNLLCKQGSPLTQKELAQLARMTDGYSGSDLTALAKDAALGPIRELKPEQVKNMSASEMRNIRLSDFTESLKKIKRSVSPQTLEAYIRWNKDFGDTTV

SEQ ID NO: 65073 - protein, 584 aa, Homo sapiens
MNSPGGRGKKKGSGGASNPVPPRPPPPCLAPAPPAAGPAPPPESPHKRNLYYFSYPLFVGFALLRLVAFHLGLLFVWLCQRFSRALMAAKRSSGAAPAPASASAPAPVPGGEAERVRVFHKQAFEYISIALRIDEDEKAGQKEQAVEWYKKGIEELEKGIAVIVTGQGEQCERARRLQAKMMTNLVMAKDRLQLLESGAVPKRKDPLTHTSNSLPRSKTVMKTGSAGLSGHHRAPSYSGLSMVSGVKQGSGPAPTTHKGTPKTNRTNKPSTPTTATRKKKDLKNFRNVDSNLANLIMNEIVDNGTAVKFDDIAGQDLAKQALQEIVILPSLRPELFTGLRAPARGLLLFGPPGNGKTMLAKAVAAESNATFFNISAASLTSKYVGEGEKLVRALFAVARELQPSIIFIDEVDSLLCERREGEHDASRRLKTEFLIEFDGVQSAGDDRVLVMGATNRPQELDEAVLRRFIKRVYVSLPNEETRLLLLKNLLCKQGSPLTQKELAQLARMTDGYSGSDLTALAKDAALGPIRELKPEQVKNMSASEMRNIRLSDFTESLKKIKRSVSPQTLEAYIRWNKDFGDTTV

SEQ ID NO: 65074 - protein, 8797 aa, Homo sapiens
MATSRGASRCPRDIANVMQRLQDEQEIVQKRTFTKWINSHLAKRKPPMVVDDLFEDMKDGVKLLALLEVLSGQKLPCEQGRRMKRIHAVANIGTALKFLEGRKIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDEILPGFPSFANSVQNFKREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEDIKTMEMVKTKWDHFGSNFETLSVWITEKEKELNALETSSSAMDMQISQIKVTIQEIESKLSSIVGLEEEAQSFAQFVTTGESARIKAKLTQIRRYGEELREHAQCLEGTILGHLSQQQKFEENLRKIQQSVSEFEDKLAVPIKICSSATETYKVLQEHMDLCQALESLSSAITAFSASARKVVNRDSCVQEAAALQQQYEDILRRAKERQTALENLLAHWQRLEKELSSFLTWLERGEAKASSPEMDISADRVKVEGELQLIQALQNEVVSQASFYSKLLQLKESLFSVASKDDVKMMKLHLEQLDERWRDLPQIINKRINFLQSVVAEHQQFDELLLSFSVWIKLFLSELQTTSEISIMDHQVALTRHKDHAAEVESKKGELQSLQGHLAKLGSLGRAEDLHLLQGKAEDCFQLFEEASQVVERRQLALSHLAEFLQSHASLSGILRQLRQTVEATNSMNKNESDLIEKDLNDALQNAKALESAAVSLDGILSKAQYHLKIGSSEQRTSCRATADQLCGEVERIQNLLGTKQSEADALAVLKKAFQDQKEELLKSIEDIEERTDKERLKEPTRQALQQRLRVFNQLEDELNSHEHELCWLKDKAKQIAQKDVAFAPEVDREINRLEVTWDDTKRLIHENQGQCCGLIDLMREYQNLKSAVSKVLENASSVIVTRTTIKDQEDLKWAFSKHETAKNKMNYKQKDLDNFTSKGKHLLSELKKIHSSDFSLVKTDMESTVDKWLDVSEKLEENMDRLRVSLSIWDDVLSTRDEIEGWSNNCVPQMAENISNLDNHLRAEELLKEFESEVKNKALRLEELHSKVNDLKELTKNLETPPDLQFIEADLMQKLEHAKEITEVAKGTLKDFTAQSTQVEKFINDITTWFTKVEESLMNCAQNETCEALKKVKDIQKELQSQQSNISSTQENLNSLCRKYHSAELESLGRAMTGLIKKHEAVSQLCSKTQASLQESLEKHFSESMQEFQEWFLGAKAAAKESSDRTGDSKVLEAKLHDLQNILDSVSDGQSKLDAVTQEGQTLYAHLSKQIVSSIQEQITKANEEFQAFLKQCLKDKQALQDCASELGSFEDQHRKLNLWIHEMEERFNTENLGESKQHIPEKKNEVHKVEMFLGELLAARESLDKLSQRGQLLSEEGHGAGQEGRLCSQLLTSHQNLLRMTKEKLRSCQVALQEHEALEEALQSMWFWVKAIQDRLACAESTLGSKDTLEKRLSQIQDILLMKGEGEVKLNMAIGKGEQALRSSNKEGQRVIQTQLETLKEVWADIMSSSVHAQSTLESVISQWNDYVERKNQLEQWMESVDQKIEHPLQPQPGLKEKFVLLDHLQSILSEAEDHTRALHRLIAKSRELYEKTEDESFKDTAQEELKTQFNDIMTVAKEKMRKVEEIVKDHLMYLDAVHEFTDWLHSAKEELHRWSDMSGDSSATQKKLSKIKELIDSREIGASRLSRVESLAPEVKQNTTASGCELMHTEMQALRADWKQWEDSVFQTQSCLENLVSQMALSEQEFSGQVAQLEQALEQFSALLKTWAQQLTLLEGKNTDEEIVECWHKGQEILDALQKAEPRTEDLKSQLNELCRFSRDLSTYSGKVSGLIKEYNCLCLQASKGCQNKEQILQQRFRKAFRDFQQWLVNAKITTAKCFDIPQNISEVSTSLQKIQEFLSESENGQHKLNMMLSKGELLSTLLTKEKAKGIQAKVTAAKEDWKNFHSNLHQKESALENLKIQMKDFEVSAEPIQDWLSKTEKMVHESSNRLYDLPAKRREQQKLQSVLEEIHCYEPQLNRLKEKAQQLWEGQAASKSFRHRVSQLSSQYLALSNLTKEKVSRLDRIVAEHNQFSLGIKELQDWMTDAIHMLDSYCHPTSDKSVLDSRTLKLEALLSVKQEKEIQMKMIVTRGESVLQNTSPEGIPTIQQQLQSVKDMWASLLSAGIRCKSQLEGALSKWTSYQDGVRQFSGWMDSMEANLNESERQHAELRDKTTMLGKAKLLNEEVLSYSSLLETIEVKGAGMTEHYVTQLELQDLQERYRAIQERAKEAVTKSEKLVRLHQEYQRDLKAFEVWLGQEQEKLDQYSVLEGDAHTHETTLRDLQELQVHCAEGQALLNSVLHTREDVIPSGIPQAEDRALESLRQDWQAYQHRLSETRTQFNNVVNKLRLMEQKFQQVDEWLKTAEEKVSPRTRRQSNRATKEIQLHQMKKWHEEVTAYRDEVEEVGARAQEILDESHVNSRMGCQATQLTSRYQALLLQVLEQIKFLEEEIQSLEESESSLSSYSDWYGSTHKNFKNVATKIDKVDTVMMGKKLKTLEVLLKDMEKGHSLLKSAREKGERAVKYLEEGEAERLRKEIHDHMEQLKELTSTVRKEHMTLEKGLHLAKEFSDKCKALTQWIAEYQEILHVPEEPKMELYEKKAQLSKYKSLQQTVLSHEPSVKSVREKGEALLELVQDVTLKDKIDQLQSDYQDLCSIGKEHVFSLEAKVKDHEDYNSELQEVEKWLLQMSGRLVAPDLLETSSLETITQQLAHHKAMMEEIAGFEDRLNNLQMKGDTLIGQCADHLQAKLKQNVHAHLQGTKDSYSAICSTAQRMYQSLEHELQKHVSRQDTLQQCQAWLSAVQPDLEPSPQPPLSRAEAIKQVKHFRALQEQARTYLDLLCSMCDLSNASVKTTAKDIQQTEQTIEQKLVQAQNLTQGWEEIKHLKSELWIYLQDADQQLQNMKRRHSELELNIAQNMVSQVKDFVKKLQSKQASVNTIIEKVNKLTKKEESPEHKEINHLNDQWLDLCRQSNNLCLQREEDLQRTRDYHDCMNVVEVFLEKFTTEWDNLARSDAESTAVHLEALKKLALALQERKYAIEDLKDQKQKMIEHLNLDDKELVKEQTSHLEQRWFQLEDLIKRKIQVSVTNLEELNVVQSRFQELMEWAEEQQPNIAEALKQSPPPDMAQNLLMDHLAICSELEAKQMLLKSLIKDADRVMADLGLNERQVIQKALSDAQSHVNCLSDLVGQRRKYLNKALSEKTQFLMAVFQATSQIQQHERKIMFREHICLLPDDVSKQVKTCKSAQASLKTYQNEVTGLWAQGRELMKEVTEQEKSEVLGKLQELQSVYDSVLQKCSHRLQELEKNLVSRKHFKEDFDKACHWLKQADIVTFPEINLMNESSELHTQLAKYQNILEQSPEYENLLLTLQRTGQTILPSLNEVDHSYLSEKLNALPRQFNVIVALAKDKFYKVQEAILARKEYASLIELTTQSLSELEAQFLRMSKVPTDLAVEEALSLQDGCRAILDEVAGLGEAVDELNQKKEGFRSTGQPWQPDKMLHLVTLYHRLKRQTEQRVSLLEDTTSAYQEHEKMCQQLERQLKSVKEEQSKVNEETLPAEEKLKMYHSLAGSLQDSGIVLKRVTIHLEDLAPHLDPLAYEKARHQIQSWQGELKLLTSAIGETVTECESRMVQSIDFQTEMSRSLDWLRRVKAELSGPVYLDLNLQDIQEEIRKIQIHQEEVQSSLRIMNALSHKEKEKFTKAKELISADLEHSLAELSELDGDIQEALRTRQATLTEIYSQCQRYYQVFQAANDWLEDAQELLQLAGNGLDVESAEENLKSHMEFFSTEDQFHSNLEELHSLVATLDPLIKPTGKEDLEQKVASLELRSQRMSRDSGAQVDLLQRCTAQWHDYQKAREEVIELMNDTEKKLSEFSLLKTSSSHEAEEKLSEHKALVSVVNSFHEKIVALEEKASQLEKTGNDASKATLSRSMTTVWQRWTRLRAVAQDQEKILEDAVDEWTGFNNKVKKATEMIDQLQDKLPGSSAEKASKAELLTLLEYHDTFVLELEQQQSALGMLRQQTLSMLQDGAAPTPGEEPPLMQEITAMQDRCLNMQEKVKTNGKLVKQELKDREMVETQINSVKCWVQETKEYLGNPTIEIDAQLEELQILLTEATNHRQNIEKMAEEQKEKYLGLYTILPSELSLQLAEVALDLKIRDQIQDKIKEVEQSKATSQELSRQIQKLAKDLTTILTKLKAKTDNVVQAKTDQKVLGEELDGCNSKLMELDAAVQKFLEQNGQLGKPLAKKIGKLTELHQQTIRQAENRLSKLNQAASHLEEYNEMLELILKWIEKAKVLAHGTIAWNSASQLREQYILHQTLLEESKEIDSELEAMTEKLQYLTSVYCTEKMSQQVAELGRETEELRQMIKIRLQNLQDAAKDMKKFEAELKKLQAALEQAQATLTSPEVGRLSLKEQLSHRQHLLSEMESLKPKVQAVQLCQSALRIPEDVVASLPLCHAALRLQEEASRLQHTAIQQCNIMQAAVVQYEQYEQEMKHLQQLIEGAHREIEDKPVATSNIQELQAQISRHEELAQKIKGYQEQIASLNSKCKMLTMKAKHATMLLTVTEVEGLAEGTEDLDGELLPTPSAHPSVVMMTAGRCHTLLSPVTEESGEEGTNSEISSPPACRSPSPVANTDASVNQDIAYYQALSAERLQTDAAKIHPSTSASQEFYEPGLEPSATAKLGDLQRSWETLKNVISEKQRTLYEALERQQKYQDSLQSISTKMEAIELKLSESPEPGRSPESQMAEHQALMDEILMLQDEINELQSSLAEELVSESCEADPAEQLALQSTLTVLAERMSTIRMKASGKRQLLEEKLNDQLEEQRQEQALQRYRCEADELDSWLLSTKATLDTALSPPKEPMDMEAQLMDCQNMLVEIEQKVVALSELSVHNENLLLEGKAHTKDEAEQLAGKLRRLKGSLLELQRALHDKQLNMQGTAQEKEESDVDLTATQSPGVQEWLAQARTTWTQQRQSSLQQQKELEQELAEQKSLLRSVASRGEEILIQHSAAETSGDAGEKPDVLSQELGMEGEKSSAEDQMRMKWESLHQEFSTKQKLLQNVLEQEQEQVLYSRPNRLLSGVPLYKGDVPTQDKSAVTSLLDGLNQAFEEVSSQSGGAKRQSIHLEQKLYDGVSATSTWLDDVEERLFVATALLPEETETCLFNQEILAKDIKEMSEEMDKNKNLFSQAFPENGDNRDVIEDTLGCLLGRLSLLDSVVNQRCHQMKERLQQILNFQNDLKVLFTSLADNKYIILQKLANVFEQPVAEQIEAIQQAEDGLKEFDAGIIELKRRGDKLQVEQPSMQELSKLQDMYDELMMIIGSRRSGLNQNLTLKSQYERALQDLADLLETGQEKMAGDQKIIVSSKEEIQQLLDKHKEYFQGLESHMILTETLFRKIISFAVQKETQFHTELMAQASAVLKRAHKRGVELEYILETWSHLDEDQQELSRQLEVVESSIPSVGLVEENEDRLIDRITLYQHLKSSLNEYQPKLYQVLDDGKRLLISISCSDLESQLNQLGECWLSNTNKMSKELHRLETILKHWTRYQSESADLIHWLQSAKDRLEFWTQQSVTVPQELEMVRDHLNAFLEFSKEVDAQSSLKSSVLSTGNQLLRLKKVDTATLRSELSRIDSQWTDLLTNIPAVQEKLHQLQMDKLPSRHAISEVMSWISLMENVIQKDEDNIKNSIGYKAIHEYLQKYKGFKIDINCKQLTVDFVNQSVLQISSQDVESKRSDKTDFAEQLGAMNKSWQILQGLVTEKIQLLEGLLESWSEYENNVQCLKTWFETQEKRLKQQHRIGDQASVQNALKDCQDLEDLIKAKEKEVEKIEQNGLALIQNKKEDVSSIVMSTLRELGQTWANLDHMVGQLKILLKSVLDQWSSHKVAFDKINSYLMEARYSLSRFRLLTGSLEAVQVQVDNLQNLQDDLEKQERSLQKFGSITNQLLKECHPPVTETLTNTLKEVNMRWNNLLEEIAEQLQSSKALLQLWQRYKDYSKQCASTVQQQEDRTNELLKAATNKDIADDEVATWIQDCNDLLKGLGTVKDSLFFLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 65075 - protein, 8409 aa, Homo sapiens
MATSRGASRCPRDIANVMQRLQDEQEIVQKRTFTKWINSHLAKRKPPMVVDDLFEDMKDGVKLLALLEVLSGQKLPCEQGRRMKRIHAVANIGTALKFLEGRKIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDEILPGFPSFANSVQNFKREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKRKLRNVIDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQLRILKCKWCNSSQKMTLCLVLGSMISMLSTAKITIAGYKSEVEVSELLACQENCKKTLTLIEKGSQSVQKFVTLSNVLKHFDQTRLQTDCRYSCCFSVMRKQHHIMIVFHIKSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEEYVIDNKTMEMVKTKWDHFGSNFETLSVWITEKEKELNALETSSSAMDMQISQIKVTIQEIESKLSSIVGLEEEAQSFAQFVTTGESARIKAKLTQIRRYGEELREHAQCLEGTILGHLSQQQKFEENLRKIQQSVSEFEDKLAVPIKICSSATETYKVLQEHMDLCQALESLSSAITAFSASARKVVNRDSCVQEAAALQQQYEDILRRAKERQTALENLLAHWQRLEKELSSFLTWLERGEAKASSPEMDISADRVKVEASKDDVKMMKLHLEQLDERWRDLPQIINKRINFLQSVVAEHQQFDELLLSFSVWIKLFLSELQTTSEISIMDHQVALTRHKDHAAEVESKKGELQSLQGHLAKLGSLGRAEDLHLLQGKAEDCFQLFEEASQVVERRQLALSHLAEFLQSHASLSGILRQLRQTVEATNSMNKNESDLIEKDLNDALQNAKALESAAVSLDGILSKAQYHLKIGSSEQRTSCRATADQLCGEVERIQNLLGTKQSEADALAVLKKAFQDQKEELLKSIEDIEERTDKERLKEPTRQALQQRLRVFNQLEDELNSHEHELCWLKDKAKQIAQKDVAFAPEVDREINRLEVTWDDTKRLIHENQGQCCGLIDLMREYQNLKSAVSKVLENASSVIVTRTTIKDQEDLKWAFSKHETAKNKMNYKQKDLDNFTSKGKHLLSELKKIHSSDFSLVKTDMESTVDKWLDVSEKLEENMDRLRVSLSIWDDVLSTRDEIEGWSNNCVPQMAENISNLDNHLRAEELLKEFESEVKNKALRLEELHSKVNDLKELTKNLETPPDLQFIEADLMQKLEHAKEITEVAKGTLKDFTAQSTQVEKFINDITTWFTKVEESLMNCAQNETCEALKKVKDIQKELQSQQSNISSTQENLNSLCRKYHSAELESLGRAMTGLIKKHEAVSQLCSKTQASLQESLEKHFSEESMQEFQEWFLGAKAAAKESSDRTGDSKVLEAKLHDLQQNILDSVSDGQSKLDAVTQEGQTLYAHLSKQIVSSIQEQITKANEEFQAFLKQCLKDKQALQDCASELGSFEDQHRKLNLWIHEMEERFNTENLGESKQHIPEKKNEVHKVEMFLGELLAARESLDKLSQRGQLLSEEGHGAGQEGRLCSQLLTSHQNLLRMTKEKLRSCQVALQEHEALEEALQSMWFWVKAIQDRLACAESTLGSKDTLEKRLSQIQDILLMKGEGEVKLNMAIGKGEQALRSSNKEGQRVIQTQLETLKEVWADIMSSSVHAQSTLESVISQWNDYVERKNQLEQWMESVDQKIEHPLQPQPGLKEKFVLLDHLQSILSEAEDHTRALHRLIAKSRELYEKTEDESFKDTAQEELKTQFNDIMTVAKEKMRKVEEIVKDHLMYLDAVHEFTDWLHSAKEELHRWSDMSGDSSATQKKLSKIKELIDSREIGASRLSRVESLAPEVKQNTTASGCELMHTEMQALRADWKQWEDSVFQTQSCLENLVSQMALSEQEFSGQVAQLEQALEQFSALLKTWAQQLTLLEGKNTDEEIVECWHKGQEILDALQKAEPRTEDLKSQLNELCRFSRDLSTYSGKVSGLIKEYNCLCLQASKGCQNKEQILQQRFRKAFRDFQQWLVNAKITTAKCFDIPQNISEVSTSLQKIQEFLSESENGQHKLNMMLSKGELLSTLLTKEKAKGIQAKVTAAKEDWKNFHSNLHQKESALENLKIQMKDFEVSAEPIQDWLSKTEKMVHESSNRLYDLPAKRREQQKLQSVLEEIHCYEPQLNRLKEKAQQLWEGQAASKSFRHRVSQLSSQYLALSNLTKEKVSRLDRIVAEHNQFSLGIKELQDWMTDAIHMLDSYCHPTSDKSVLDSRTLKLEALLSVKQEKEIQMKMIVTRGESVLQNTSPEGIPTIQQQLQSVKDMWASLLSAGIRCKRVRLPCAYIALKLRVHQHAELRDKTTMLGKAKEAVTKSEKLVRLHQEYQRDLKAFEVWLGQEQEKLDQYSVLEGDAHTHETTLRDLQELQVHCAEGQALLNSVLHTREDVIPSGIPQAEDRALESLRQDWQAYQHRLSETRTQFNNVVNKLRLMEQKFQQVDEWLKTAEEKVSPRTRRQSNRATKEIQLHQMKKWHEEVTAYRDEVEEVGARAQEILDESHVNSRMGCQATQLTSRYQALLLQVLEQIKFLEEEIQSLEESESSLSSYSDWYGSTHKNFKNVATKIDKVDTVMMGKKLKTLEVLLKDMEKGHSLLKSAREKGERAVKYLEEGEAERLRKEIHDHMEQLKELTSTVRKEHMTLEKSLQQTVLSHEPSVKSVREKGEALLELVQDVTLKDKIDQLQSDYQDLCSIGKEHVFSLEAKVKDHEDYNSELQEVEKWLLQMSGRLVAPDLLETSSLETITQQLAHHKMYQSLEHELQKHVSRQDTLQQCQAWLSAVQPDLEPSPQPPLSRAEAIKQVKHFRALQEQARTYLDLLCSMCDLSNASVKTTAKDIQQTEQTIEQKLVQAQNLTQGWEEIKHLKSELWIYLQDADQQLQNMKRRHSELELNIAQNMVSQVKDFVKKLQSKQASVNTIIEKVNKLTKKEESPEHKEINHLNDQWLDLCRQSNNLCLQREEDLQRTRDYHDCMNVVEVFLEKFTTEWDNLARSDAESTAVHLEALKKLALALQERKYAIEDLKDQKQKMIEHLNLDDKELVKEQTSHLEQRWFQLEDLIKRKIQVSVTNLEELNVVQSRFQELMEWAEEQQPNIAEALKQSPPPDMAQNLLMDHLAICSELEAKQMLLKSLIKDADRVMADLGLNERQVIQKALSDAQSHVNCLSDLVGQRRKKHFKEDFDKACHWLKQADIVTFPEINLMNESSELHTQLAKYQNILEQSPEYENLLLTLQRTGQTILPSLNEVDHSYLSEKLNALPRQFNVIVALAKDKFYKVQEAILARKEYASLIELTTQSLSELEAQFLRMSKVPTDLAVEEALSLQDGCRAILDEVAGLGEAVDELNQKKEGFRSTGQPWQPDKMLHLVTLYHRLKRQTEQRVSLLEDTTSAYQEHEKMCQQLERQLKSVKEEQSKVNEETLPAEEKLKMYHSLAGSLQDSGIVLKRVTIHLEDLAPHLDPLAYEKARHQIQSWQGELKLLTSAIGETVTECESRMVQSIDFQTEMSRSLDWLRRVKAELSGPVYLDLNLQDIQEEIRKIQIHQEEVQSSLRIMNALSHKEKEKFTKAKELISADLEHSLAELSELDGDIQEALRTRQATLTEIYSQCQRYYQVFQAANDWLEDAQELLQLAGNGLDVESAEENLKSHMEFFSTEDQFHSNLEELHSLVATLDPLIKPTGKEDLEQKVASLELRSQRMSRDSGAQALVSVVNSFHEKIVALEEKASQLEKTGNDASKATLSRSMTTVWQRWTRLRAVAQDQEKILEDAVDEWTGFNNKVKKATEMIDQLQDKLPGSSAEKASKAELLTLLEYHDTFVLELEQQQSALGMLRQQTLSMLQDGAAPTPGEEPPLMQEITAMQDRCLKMVETQINSVKCWVQETKEYLGNPTIEIDAQLEELQILLTEATNHRQNIEKMAEEQKEKYLGLYTILPSELSLQLAEVALDLKIRDQIQDKIKEVEQSKATSQELSRQIQKLAKDLTTILTKLKAKTDNVVQAKTDQKAASHLEEYNEMLELILKWIEKAKVLAHGTIAWNSASQLREQYILHQTLLEESKEIDSELEAMTEKLQYLTSVYCTEKMSQQVAELGRETEELRQMIKIRLQNLQDAAKDMKKFEAELKKLQAALEQAQATLTSPEVGRLSLKEQLSHRQHLLSEMESLKPKVQAVQLCQSALRIPEDVVASLPLCHAALRLQEEASRLQHTAIQQCNIMQEAVVQYEQYEQEMKHLQQLIEGAHREIEDKPVATSNIQELQAQISRHEELAQKIKGYQEQIASLNSKCKMLTMKAKHATMLLTVTEVEGLAEGTEDLDGELLPTPSAHPSVVMMTAGRCHTLLSPVTEESGEEGTNSEISSPPACRSPSPVANTDASVNQDIAYYQALSAERLQTDAAKIHPSTSASQEFYEPGLEPSATAKLGDLQRSWETLKNVISEKQRTLYEALERQQKYQDSLQSISTKMEAIELKLSESPEPGRSPESQMAEHQALMDEILMLQDEINELQSSLAEELVSESCEADPAEQLALQSTLTVLAERMSTIRMKASGKRQLLEEKLNDQLEEQRQEQALQRYRCEADELDSWLLSTKATLDTALSPPKEPMDMEAQLMDCQNMLVEIEQKVVALSELSVHNENLLLEGKAHTKDEAEQLAGKLRRLKGSLLELQRALHDKQLNMQGTAQEKEESDVDLTATQSPGVQEWLAQARTTWTQQRQSSLQQQKELEQELAEQKSLLRSVASRGEEILIQHSAAETSGDAGEKPDVLSQELGMEGEKSSAEDQMRMKWESLHQEFSTKQKLLQNVLEQEQEQVLYSRPNRLLSGVPLYKGDVPTQDKSAVTSLLDGLNQAFEEVSSQSGGAKRQSIHLEQKLYDGVSATSTWLDDVEERLFVATALLPEETETCLFNQEILAKDIKEMSEEMDKNKNLFSQAFPENGDNRDVIEDTLGCLLGRLSLLDSVVNQRCHQMKERLQQILNFQNDLKVLFTSLADNKYIILQKLANVFEQPVAEQIEAIQQAEDGLKEFDAGIIELKRRGDKLQVEQPSMQELSKLQDMYDELMMIIGSRRSGLNQNLTLKSQYERALQDLADLLETGQEKMAGDQKIIVSSKEEIQQLLDKHKEYFQGLESHMILTETLFRKIISFAVQKETQFHTELMAQASAVLKRAHKRGVELEYILETWSHLDEDQQELSRQLEVVESSIPSVGLVEENEDRLIDRITLYQHLKSSLNEYQPKLYQVLDDGKRLLISISCSDLESQLNQLGECWLSNTNKMSKELHRLETILKHWTRYQSESADLIHWLQSAKDRLEFWTQQSVTVPQELEMVRDHLNAFLEFSKEVDAQSSLKSSVLSTGNQLLRLKKVDTATLRSELSRIDSQWTDLLTNIPAVQEKLHQLQMDKLPSRHAISEVMSWISLMENVIQKDEDNIKNSIGYKAIHEYLQKYKGFKIDINCKQLTVDFVNQSVLQISSQDVESKRSDKTDFAEQLGAMNKSWQILQGLVTEKIQLLEGLLESWSEYENNVQCLKTWFETQEKRLKQQHRIGDQASVQNALKDCQDLEDLIKAKEKEVEKIEQNGLALIQNKKEDVSSIVMSTLRELGQTWANLDHMVGQLKILLKSVLDQWSSHKVAFDKINSYLMEARYSLSRFRLLTGSLEAVQVQVDNLQNLQDDLEKQERSLQKFGSITNQLLKECHPPVTETLTNTLKEVNMRWNNLLEEIAEQLQSSKALLQLWQRYKDYSKQCASTVQQQEDRTNELLKAATNKDIADDEVATWIQDCNDLLKGLGTVKDSLFFLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 65076 - protein, 3321 aa, Homo sapiens
MELDAAVQKFLEQNGQLGKPLAKKIGKLTELHQQTIRQAENRLSKLNQAASHLEEYNEMLELILKWIEKAKVLAHGTIAWNSASQLREQYILHQTLLEESKEIDSELEAMTEKLQYLTSVYCTEKMSQQVAELGRETEELRQMIKIRLQNLQDAAKDMKKFEAELKKLQAALEQAQATLTSPEVGRLSLKEQLSHRQHLLSEMESLKPKVQAVQLCQSALRIPEDVVASLPLCHAALRLQEEASRLQHTAIQQCNIMQAAVVQYEQYEQEMKHLQQLIEGAHREIEDKPVATSNIQELQAQISRHEELAQKIKGYQEQIASLNSKCKMLTMKAKHATMLLTVTEVEGLAEGTEDLDGELLPTPSAHPSVVMMTAGRCHTLLSPVTEESGEEGTNSEISSPPACRSPSPVANTDASVNQDIAYYQALSAERLQTDAAKIHPSTSASQEFYEPGLEPSATAKLGDLQRSWETLKNVISEKQRTLYEALERQQKYQDSLQSISTKMEAIELKLSESPEPGRSPESQMAEHQALMDEILMLQDEINELQSSLAEELVSESCEADPAEQLALQSTLTVLAERMSTIRMKASGKRQLLEEKLNDQLEEQRQEQALQRYRCEADELDSWLLSTKATLDTALSPPKEPMDMEAQLMDCQNMLVEIEQKVVALSELSVHNENLLLEGKAHTKDEAEQLAGKLRRLKGSLLELQRALHDKQLNMQGTAQEKEESDVDLTATQSPGVQEWLAQARTTWTQQRQSSLQQQKELEQELAEQKSLLRSVASRGEEILIQHSAAETSGDAGEKPDVLSQELGMEGEKSSAEDQMRMKWESLHQEFSTKQKLLQNVLEQEQEQVLYSRPNRLLSGVPLYKGDVPTQDKSAVTSLLDGLNQAFEEVSSQSGGAKRQSIHLEQKLYDGVSATSTWLDDVEERLFVATALLPEETETCLFNQEILAKDIKEMSEEMDKNKNLFSQAFPENGDNRDVIEDTLGCLLGRLSLLDSVVNQRCHQMKERLQQILNFQNDLKVLFTSLADNKYIILQKLANVFEQPVAEQIEAIQQAEDGLKEFDAGIIELKRRGDKLQVEQPSMQELSKLQDMYDELMMIIGSRRSGLNQNLTLKSQYERALQDLADLLETGQEKMAGDQKIIVSSKEEIQQLLDKHKEYFQGLESHMILTETLFRKIISFAVQKETQFHTELMAQASAVLKRAHKRGVELEYILETWSHLDEDQQELSRQLEVVESSIPSVGLVEENEDRLIDRITLYQHLKSSLNEYQPKLYQVLDDGKRLLISISCSDLESQLNQLGECWLSNTNKMSKELHRLETILKHWTRYQSESADLIHWLQSAKDRLEFWTQQSVTVPQELEMVRDHLNAFLEFSKEVDAQSSLKSSVLSTGNQLLRLKKVDTATLRSELSRIDSQWTDLLTNIPAVQEKLHQLQMDKLPSRHAISEVMSWISLMENVIQKDEDNIKNSIGYKAIHEYLQKYKGFKIDINCKQLTVDFVNQSVLQISSQDVESKRSDKTDFAEQLGAMNKSWQILQGLVTEKIQLLEGLLESWSEYENNVQCLKTWFETQEKRLKQQHRIGDQASVQNALKDCQDLEDLIKAKEKEVEKIEQNGLALIQNKKEDVSSIVMSTLRELGQTWANLDHMVGQLKILLKSVLDQWSSHKVAFDKINSYLMEARYSLSRFRLLTGSLEAVQVQVDNLQNLQDDLEKQERSLQKFGSITNQLLKECHPPVTETLTNTLKEVNMRWNNLLEEIAEQLQSSKALLQLWQRYKDYSKQCASTVQQQEDRTNELLKAATNKDIADDEVATWIQDCNDLLKGLGTVKDSLFFLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 65077 - protein, 977 aa, Homo sapiens
MVVAEDLSALRMAEDSCVDADLPDCNCDVTRQRVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSDVMIPESPEAYVKLTENAIKNTSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 65078 - protein, 8797 aa, Homo sapiens
MATSRGASRCPRDIANVMQRLQDEQEIVQKRTFTKWINSHLAKRKPPMVVDDLFEDMKDGVKLLALLEVLSGQKLPCEQGRRMKRIHAVANIGTALKFLEGRKIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDEILPGFPSFANSVQNFKREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEDIKTMEMVKTKWDHFGSNFETLSVWITEKEKELNALETSSSAMDMQISQIKVTIQEIESKLSSIVGLEEEAQSFAQFVTTGESARIKAKLTQIRRYGEELREHAQCLEGTILGHLSQQQKFEENLRKIQQSVSEFEDKLAVPIKICSSATETYKVLQEHMDLCQALESLSSAITAFSASARKVVNRDSCVQEAAALQQQYEDILRRAKERQTALENLLAHWQRLEKELSSFLTWLERGEAKASSPEMDISADRVKVEGELQLIQALQNEVVSQASFYSKLLQLKESLFSVASKDDVKMMKLHLEQLDERWRDLPQIINKRINFLQSVVAEHQQFDELLLSFSVWIKLFLSELQTTSEISIMDHQVALTRHKDHAAEVESKKGELQSLQGHLAKLGSLGRAEDLHLLQGKAEDCFQLFEEASQVVERRQLALSHLAEFLQSHASLSGILRQLRQTVEATNSMNKNESDLIEKDLNDALQNAKALESAAVSLDGILSKAQYHLKIGSSEQRTSCRATADQLCGEVERIQNLLGTKQSEADALAVLKKAFQDQKEELLKSIEDIEERTDKERLKEPTRQALQQRLRVFNQLEDELNSHEHELCWLKDKAKQIAQKDVAFAPEVDREINRLEVTWDDTKRLIHENQGQCCGLIDLMREYQNLKSAVSKVLENASSVIVTRTTIKDQEDLKWAFSKHETAKNKMNYKQKDLDNFTSKGKHLLSELKKIHSSDFSLVKTDMESTVDKWLDVSEKLEENMDRLRVSLSIWDDVLSTRDEIEGWSNNCVPQMAENISNLDNHLRAEELLKEFESEVKNKALRLEELHSKVNDLKELTKNLETPPDLQFIEADLMQKLEHAKEITEVAKGTLKDFTAQSTQVEKFINDITTWFTKVEESLMNCAQNETCEALKKVKDIQKELQSQQSNISSTQENLNSLCRKYHSAELESLGRAMTGLIKKHEAVSQLCSKTQASLQESLEKHFSESMQEFQEWFLGAKAAAKESSDRTGDSKVLEAKLHDLQNILDSVSDGQSKLDAVTQEGQTLYAHLSKQIVSSIQEQITKANEEFQAFLKQCLKDKQALQDCASELGSFEDQHRKLNLWIHEMEERFNTENLGESKQHIPEKKNEVHKVEMFLGELLAARESLDKLSQRGQLLSEEGHGAGQEGRLCSQLLTSHQNLLRMTKEKLRSCQVALQEHEALEEALQSMWFWVKAIQDRLACAESTLGSKDTLEKRLSQIQDILLMKGEGEVKLNMAIGKGEQALRSSNKEGQRVIQTQLETLKEVWADIMSSSVHAQSTLESVISQWNDYVERKNQLEQWMESVDQKIEHPLQPQPGLKEKFVLLDHLQSILSEAEDHTRALHRLIAKSRELYEKTEDESFKDTAQEELKTQFNDIMTVAKEKMRKVEEIVKDHLMYLDAVHEFTDWLHSAKEELHRWSDMSGDSSATQKKLSKIKELIDSREIGASRLSRVESLAPEVKQNTTASGCELMHTEMQALRADWKQWEDSVFQTQSCLENLVSQMALSEQEFSGQVAQLEQALEQFSALLKTWAQQLTLLEGKNTDEEIVECWHKGQEILDALQKAEPRTEDLKSQLNELCRFSRDLSTYSGKVSGLIKEYNCLCLQASKGCQNKEQILQQRFRKAFRDFQQWLVNAKITTAKCFDIPQNISEVSTSLQKIQEFLSESENGQHKLNMMLSKGELLSTLLTKEKAKGIQAKVTAAKEDWKNFHSNLHQKESALENLKIQMKDFEVSAEPIQDWLSKTEKMVHESSNRLYDLPAKRREQQKLQSVLEEIHCYEPQLNRLKEKAQQLWEGQAASKSFRHRVSQLSSQYLALSNLTKEKVSRLDRIVAEHNQFSLGIKELQDWMTDAIHMLDSYCHPTSDKSVLDSRTLKLEALLSVKQEKEIQMKMIVTRGESVLQNTSPEGIPTIQQQLQSVKDMWASLLSAGIRCKSQLEGALSKWTSYQDGVRQFSGWMDSMEANLNESERQHAELRDKTTMLGKAKLLNEEVLSYSSLLETIEVKGAGMTEHYVTQLELQDLQERYRAIQERAKEAVTKSEKLVRLHQEYQRDLKAFEVWLGQEQEKLDQYSVLEGDAHTHETTLRDLQELQVHCAEGQALLNSVLHTREDVIPSGIPQAEDRALESLRQDWQAYQHRLSETRTQFNNVVNKLRLMEQKFQQVDEWLKTAEEKVSPRTRRQSNRATKEIQLHQMKKWHEEVTAYRDEVEEVGARAQEILDESHVNSRMGCQATQLTSRYQALLLQVLEQIKFLEEEIQSLEESESSLSSYSDWYGSTHKNFKNVATKIDKVDTVMMGKKLKTLEVLLKDMEKGHSLLKSAREKGERAVKYLEEGEAERLRKEIHDHMEQLKELTSTVRKEHMTLEKGLHLAKEFSDKCKALTQWIAEYQEILHVPEEPKMELYEKKAQLSKYKSLQQTVLSHEPSVKSVREKGEALLELVQDVTLKDKIDQLQSDYQDLCSIGKEHVFSLEAKVKDHEDYNSELQEVEKWLLQMSGRLVAPDLLETSSLETITQQLAHHKAMMEEIAGFEDRLNNLQMKGDTLIGQCADHLQAKLKQNVHAHLQGTKDSYSAICSTAQRMYQSLEHELQKHVSRQDTLQQCQAWLSAVQPDLEPSPQPPLSRAEAIKQVKHFRALQEQARTYLDLLCSMCDLSNASVKTTAKDIQQTEQTIEQKLVQAQNLTQGWEEIKHLKSELWIYLQDADQQLQNMKRRHSELELNIAQNMVSQVKDFVKKLQSKQASVNTIIEKVNKLTKKEESPEHKEINHLNDQWLDLCRQSNNLCLQREEDLQRTRDYHDCMNVVEVFLEKFTTEWDNLARSDAESTAVHLEALKKLALALQERKYAIEDLKDQKQKMIEHLNLDDKELVKEQTSHLEQRWFQLEDLIKRKIQVSVTNLEELNVVQSRFQELMEWAEEQQPNIAEALKQSPPPDMAQNLLMDHLAICSELEAKQMLLKSLIKDADRVMADLGLNERQVIQKALSDAQSHVNCLSDLVGQRRKYLNKALSEKTQFLMAVFQATSQIQQHERKIMFREHICLLPDDVSKQVKTCKSAQASLKTYQNEVTGLWAQGRELMKEVTEQEKSEVLGKLQELQSVYDSVLQKCSHRLQELEKNLVSRKHFKEDFDKACHWLKQADIVTFPEINLMNESSELHTQLAKYQNILEQSPEYENLLLTLQRTGQTILPSLNEVDHSYLSEKLNALPRQFNVIVALAKDKFYKVQEAILARKEYASLIELTTQSLSELEAQFLRMSKVPTDLAVEEALSLQDGCRAILDEVAGLGEAVDELNQKKEGFRSTGQPWQPDKMLHLVTLYHRLKRQTEQRVSLLEDTTSAYQEHEKMCQQLERQLKSVKEEQSKVNEETLPAEEKLKMYHSLAGSLQDSGIVLKRVTIHLEDLAPHLDPLAYEKARHQIQSWQGELKLLTSAIGETVTECESRMVQSIDFQTEMSRSLDWLRRVKAELSGPVYLDLNLQDIQEEIRKIQIHQEEVQSSLRIMNALSHKEKEKFTKAKELISADLEHSLAELSELDGDIQEALRTRQATLTEIYSQCQRYYQVFQAANDWLEDAQELLQLAGNGLDVESAEENLKSHMEFFSTEDQFHSNLEELHSLVATLDPLIKPTGKEDLEQKVASLELRSQRMSRDSGAQVDLLQRCTAQWHDYQKAREEVIELMNDTEKKLSEFSLLKTSSSHEAEEKLSEHKALVSVVNSFHEKIVALEEKASQLEKTGNDASKATLSRSMTTVWQRWTRLRAVAQDQEKILEDAVDEWTGFNNKVKKATEMIDQLQDKLPGSSAEKASKAELLTLLEYHDTFVLELEQQQSALGMLRQQTLSMLQDGAAPTPGEEPPLMQEITAMQDRCLNMQEKVKTNGKLVKQELKDREMVETQINSVKCWVQETKEYLGNPTIEIDAQLEELQILLTEATNHRQNIEKMAEEQKEKYLGLYTILPSELSLQLAEVALDLKIRDQIQDKIKEVEQSKATSQELSRQIQKLAKDLTTILTKLKAKTDNVVQAKTDQKVLGEELDGCNSKLMELDAAVQKFLEQNGQLGKPLAKKIGKLTELHQQTIRQAENRLSKLNQAASHLEEYNEMLELILKWIEKAKVLAHGTIAWNSASQLREQYILHQTLLEESKEIDSELEAMTEKLQYLTSVYCTEKMSQQVAELGRETEELRQMIKIRLQNLQDAAKDMKKFEAELKKLQAALEQAQATLTSPEVGRLSLKEQLSHRQHLLSEMESLKPKVQAVQLCQSALRIPEDVVASLPLCHAALRLQEEASRLQHTAIQQCNIMQEAVVQYEQYEQEMKHLQQLIEGAHREIEDKPVATSNIQELQAQISRHEELAQKIKGYQEQIASLNSKCKMLTMKAKHATMLLTVTEVEGLAEGTEDLDGELLPTPSAHPSVVMMTAGRCHTLLSPVTEESGEEGTNSEISSPPACRSPSPVANTDASVNQDIAYYQALSAERLQTDAAKIHPSTSASQEFYEPGLEPSATAKLGDLQRSWETLKNVISEKQRTLYEALERQQKYQDSLQSISTKMEAIELKLSESPEPGRSPESQMAEHQALMDEILMLQDEINELQSSLAEELVSESCEADPAEQLALQSTLTVLAERMSTIRMKASGKRQLLEEKLNDQLEEQRQEQALQRYRCEADELDSWLLSTKATLDTALSPPKEPMDMEAQLMDCQNMLVEIEQKVVALSELSVHNENLLLEGKAHTKDEAEQLAGKLRRLKGSLLELQRALHDKQLNMQGTAQEKEESDVDLTATQSPGVQEWLAQARTTWTQQRQSSLQQQKELEQELAEQKSLLRSVASRGEEILIQHSAAETSGDAGEKPDVLSQELGMEGEKSSAEDQMRMKWESLHQEFSTKQKLLQNVLEQEQEQVLYSRPNRLLSGVPLYKGDVPTQDKSAVTSLLDGLNQAFEEVSSQSGGAKRQSIHLEQKLYDGVSATSTWLDDVEERLFVATALLPEETETCLFNQEILAKDIKEMSEEMDKNKNLFSQAFPENGDNRDVIEDTLGCLLGRLSLLDSVVNQRCHQMKERLQQILNFQNDLKVLFTSLADNKYIILQKLANVFEQPVAEQIEAIQQAEDGLKEFDAGIIELKRRGDKLQVEQPSMQELSKLQDMYDELMMIIGSRRSGLNQNLTLKSQYERALQDLADLLETGQEKMAGDQKIIVSSKEEIQQLLDKHKEYFQGLESHMILTETLFRKIISFAVQKETQFHTELMAQASAVLKRAHKRGVELEYILETWSHLDEDQQELSRQLEVVESSIPSVGLVEENEDRLIDRITLYQHLKSSLNEYQPKLYQVLDDGKRLLISISCSDLESQLNQLGECWLSNTNKMSKELHRLETILKHWTRYQSESADLIHWLQSAKDRLEFWTQQSVTVPQELEMVRDHLNAFLEFSKEVDAQSSLKSSVLSTGNQLLRLKKVDTATLRSELSRIDSQWTDLLTNIPAVQEKLHQLQMDKLPSRHAISEVMSWISLMENVIQKDEDNIKNSIGYKAIHEYLQKYKGFKIDINCKQLTVDFVNQSVLQISSQDVESKRSDKTDFAEQLGAMNKSWQILQGLVTEKIQLLEGLLESWSEYENNVQCLKTWFETQEKRLKQQHRIGDQASVQNALKDCQDLEDLIKAKEKEVEKIEQNGLALIQNKKEDVSSIVMSTLRELGQTWANLDHMVGQLKILLKSVLDQWSSHKVAFDKINSYLMEARYSLSRFRLLTGSLEAVQVQVDNLQNLQDDLEKQERSLQKFGSITNQLLKECHPPVTETLTNTLKEVNMRWNNLLEEIAEQLQSSKALLQLWQRYKDYSKQCASTVQQQEDRTNELLKAATNKDIADDEVATWIQDCNDLLKGLGTVKDSLFFLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 65079 - protein, 8749 aa, Homo sapiens
MATSRGASRCPRDIANVMQRLQDEQEIVQKRTFTKWINSHLAKRKPPMVVDDLFEDMKDGVKLLALLEVLSGQKLPCEQGRRMKRIHAVANIGTALKFLEGRKSMHRGSPIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDEILPGFPSFANSVQNFKREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEDIKTMEMVKTKWDHFGSNFETLSVWITEKEKELNALETSSSAMDMQISQIKVTIQEIESKLSSIVGLEEEAQSFAQFVTTGESARIKAKLTQIRRYGEELREHAQCLEGTILGHLSQQQKFEENLRKIQQSVSEFEDKLAVPIKICSSATETYKVLQEHMDLCQALESLSSAITAFSASARKVVNRDSCVQEAAALQQQYEDILRRAKERQTALENLLAHWQRLEKELSSFLTWLERGEAKASSPEMDISADRVKVEGELQLIQALQNEVVSQASFYSKLLQLKESLFSVASKDDVKMMKLHLEQLDERWRDLPQIINKRINFLQSVVAEHQQFDELLLSFSVWIKLFLSELQTTSEISIMDHQVALTRHKDHAAEVESKKGELQSLQGHLAKLGSLGRAEDLHLLQGKAEDCFQLFEEASQVVERRQLALSHLAEFLQSHASLSGILRQLRQTVEATNSMNKNESDLIEKDLNDALQNAKALESAAVSLDGILSKAQYHLKIGSSEQRTSCRATADQLCGEVERIQNLLGTKQSEADALAVLKKAFQDQKEELLKSIEDIEERTDKERLKEPTRQALQQRLRVFNQLEDELNSHEHELCWLKDKAKQIAQKDVAFAPEVDREINRLEVTWDDTKRLIHENQGQCCGLIDLMREYQNLKSAVSKVLENASSVIVTRTTIKDQEDLKWAFSKHETAKNKMNYKQKDLDNFTSKGKHLLSELKKIHSSDFSLVKTDMESTVDKWLDVSEKLEENMDRLRVSLSIWDDVLSTRDEIEGWSNNCVPQMAENISNLDNHLRAEELLKEFESEVKNKALRLEELHSKVNDLKELTKNLETPPDLQFIEADLMQKLEHAKEITEVAKGTLKDFTAQSTQVEKFINDITTWFTKVEESLMNCAQNETCEALKKVKDIQKELQSQQSNISSTQENLNSLCRKYHSAELESLGRAMTGLIKKHEAVSQLCSKTQASLQESLEKHFSESMQEFQEWFLGAKAAAKESSDRTGDSKVLEAKLHDLQNILDSVSDGQSKLDAVTQEGQTLYAHLSKQIVSSIQEQITKANEEFQAFLKQCLKDKQALQDCASELGSFEDQHRKLNLWIHEMEERFNTENLGESKQHIPEKKNEVHKVEMFLGELLAARESLDKLSQRGQLLSEEGHGAGQEGRLCSQLLTSHQNLLRMTKEKLRSCQVALQEHEALEEALQSMWFWVKAIQDRLACAESTLGSKDTLEKRLSQIQDILLMKGEGEVKLNMAIGKGEQALRSSNKEGQRVIQTQLETLKEVWADIMSSSVHAQSTLESVISQWNDYVERKNQLEQWMESVDQKIEHPLQPQPGLKEKFVLLDHLQSILSEAEDHTRALHRLIAKSRELYEKTEDESFKDTAQEELKTQFNDIMTVAKEKMRKVEEIVKDHLMYLDAVHEFTDWLHSAKEELHRWSDMSGDSSATQKKLSKIKELIDSREIGASRLSRVESLAPEVKQNTTASGCELMHTEMQALRADWKQWEDSVFQTQSCLENLVSQMALSEQEFSGQVAQLEQALEQFSALLKTWAQQLTLLEGKNTDEEIVECWHKGQEILDALQKAEPRTEDLKSQLNELCRFSRDLSTYSGKVSGLIKEYNCLCLQASKGCQNKEQILQQRFRKAFRDFQQWLVNAKITTAKCFDIPQNISEVSTSLQKIQEFLSESENGQHKLNMMLSKGELLSTLLTKEKAKGIQAKVTAAKEDWKNFHSNLHQKESALENLKIQMKDFEVSAEPIQDWLSKTEKMVHESSNRLYDLPAKRREQQKLQSVLEEIHCYEPQLNRLKEKAQQLWEGQAASKSFRHRVSQLSSQYLALSNLTKEKVSRLDRIVAEHNQFSLGIKELQDWMTDAIHMLDSYCHPTSDKSVLDSRTLKLEALLSVKQEKEIQMKMIVTRGESVLQNTSPEGIPTIQQQLQSVKDMWASLLSAGIRCKSQLEGALSKWTSYQDGVRQFSGWMDSMEANLNESERQHAELRDKTTMLGKAKLLNEEVLSYSSLLETIEVKGAGMTEHYVTQLELQDLQERYRAIQERAKEAVTKSEKLVRLHQEYQRDLKAFEVWLGQEQEKLDQYSVLEGDAHTHETTLRDLQELQVHCAEGQALLNSVLHTREDVIPSGIPQAEDRALESLRQDWQAYQHRLSETRTQFNNVVNKLRLMEQKFQQVDEWLKTAEEKKWHEEVTAYRDEVEEVGARAQEILDESHVNSRMGCQATQLTSRYQALLLQVLEQIKFLEEEIQSLEESESSLSSYSDWYGSTHKNFKNVATKIDKVDTVMMGKKLKTLEVLLKDMEKGHSLLKSAREKGERAVKYLEEGEAERLRKEIHDHMEQLKELTSTVRKEHMTLEKGLHLAKEFSDKCKALTQWIAEYQEILHVPEEPKMELYEKKAQLSKYKSLQQTVLSHEPSVKSVREKGEALLELVQDVTLKDKIDQLQSDYQDLCSIGKAMMEEIAGFEDRLNNLQMKGDTLIGQCADHLQAKLKQNVHAHLQGTKDSYSAICSTAQRMYQSLEHELQKHVSRQDTLQQCQAWLSAVQPDLEPSPQPPLSRAEAIKQVKHFRALQEQARTYLDLLCSMCDLSNASVKTTAKDIQQTEQTIEQKLVQAQNLTQGWEEIKHLKSELWIYLQDADQQLQNMKRRHSELELNIAQNMVSQVKDFVKKLQSKQASVNTIIEKVNKLTKKEESPEHKEINHLNDQWLDLCRQSNNLCLQREEDLQRTRDYHDCMNVVEVFLEKFTTEWDNLARSDAESTAVHLEALKKLALALQERKYAIEDLKDQKQKMIEHLNLDDKELVKEQTSHLEQRWFQLEDLIKRKIQVSVTNLEELNVVQSRFQELMEWAEEQQPNIAEALKQSPPPDMAQNLLMDHLAICSELEAKQMLLKSLIKDADRVMADLGLNERQVIQKALSDAQSHVNCLSDLVGQRRKYLNKALSEKTQFLMAVFQATSQIQQHERKIMFREHICLLPDDVSKQVKTCKSAQASLKTYQNEVTGLWAQGRELMKEVTEQEKSEVLGKLQELQSVYDSVLQKCSHRLQELEKNLVSRKHFKEDFDKACHWLKQADIVTFPEINLMNESSELHTQLAKYQNILEQSPEYENLLLTLQRTGQTILPSLNEVDHSYLSEKLNALPRQFNVIVALAKDKFYKVQEAILARKEYASLIELTTQSLSELEAQFLRMSKVPTDLAVEEALSLQDGCRAILDEVAGLGEAVDELNQKKEGFRSTGQPWQPDKMLHLVTLYHRLKRQTEQRVSLLEDTTSAYQEHEKMCQQLERQLKSVKEEQSKVNEETLPAEEKLKMYHSLAGSLQDSGIVLKRVTIHLEDLAPHLDPLAYEKARHQIQSWQGELKLLTSAIGETVTECESRMVQSIDFQTEMSRSLDWLRRVKAELSGPVYLDLNLQDIQEEIRKIQIHQEEVQSSLRIMNALSHKEKEKFTKAKELISADLEHSLAELSELDGDIQEALRTRQATLTEIYSQCQRYYQVFQAANDWLEDAQELLQLAGNGLDVESAEENLKSHMEFFSTEDQFHSNLEELHSLVATLDPLIKPTGKEDLEQKVASLELRSQRMSRDSGAQVDLLQRCTAQWHDYQKAREEVIELMNDTEKKLSEFSLLKTSSSHEAEEKLSEHKALVSVVNSFHEKIVALEEKASQLEKTGNDASKATLSRSMTTVWQRWTRLRAVAQDQEKILEDAVDEWTGFNNKVKKATEMIDQLQDKLPGSSAEKASKAELLTLLEYHDTFVLELEQQQSALGMLRQQTLSMLQDGAAPTPGEEPPLMQEITAMQDRCLNMQEKVKTNGKLVKQELKDREMVETQINSVKCWVQETKEYLGNPTIEIDAQLEELQILLTEATNHRQNIEKMAEEQKEKYLGLYTILPSELSLQLAEVALDLKIRDQIQDKIKEVEQSKATSQELSRQIQKLAKDLTTILTKLKAKTDNVVQAKTDQKVLGEELDGCNSKLMELDAAVQKFLEQNGQLGKPLAKKIGKLTELHQQTIRQAENRLSKLNQAASHLEEYNEMLELILKWIEKAKVLAHGTIAWNSASQLREQYILHQTLLEESKEIDSELEAMTEKLQYLTSVYCTEKMSQQVAELGRETEELRQMIKIRLQNLQDAAKDMKKFEAELKKLQAALEQAQATLTSPEVGRLSLKEQLSHRQHLLSEMESLKPKVQAVQLCQSALRIPEDVVASLPLCHAALRLQEEASRLQHTAIQQCNIMQAAVVQYEQYEQEMKHLQQLIEGAHREIEDKPVATSNIQELQAQISRHEELAQKIKGYQEQIASLNSKCKMLTMKAKHATMLLTVTEVEGLAEGTEDLDGELLPTPSAHPSVVMMTAGRCHTLLSPVTEESGEEGTNSEISSPPACRSPSPVANTDASVNQDIAYYQALSAERLQTDAAKIHPSTSASQEFYEPGLEPSATAKLGDLQRSWETLKNVISEKQRTLYEALERQQKYQDSLQSISTKMEAIELKLSESPEPGRSPESQMAEHQALMDEILMLQDEINELQSSLAEELVSESCEADPAEQLALQSTLTVLAERMSTIRMKASGKRQLLEEKLNDQLEEQRQEQALQRYRCEADELDSWLLSTKATLDTALSPPKEPMDMEAQLMDCQNMLVEIEQKVVALSELSVHNENLLLEGKAHTKDEAEQLAGKLRRLKGSLLELQRALHDKQLNMQGTAQEKEESDVDLTATQSPGVQEWLAQARTTWTQQRQSSLQQQKELEQELAEQKSLLRSVASRGEEILIQHSAAETSGDAGEKPDVLSQELGMEGEKSSAEDQMRMKWESLHQEFSTKQKLLQNVLEQEQEQVLYSRPNRLLSGVPLYKGDVPTQDKSAVTSLLDGLNQAFEEVSSQSGGAKRQSIHLEQKLYDGVSATSTWLDDVEERLFVATALLPEETETCLFNQEILAKDIKEMSEEMDKNKNLFSQAFPENGDNRDVIEDTLGCLLGRLSLLDSVVNQRCHQMKERLQQILNFQNDLKVLFTSLADNKYIILQKLANVFEQPVAEQIEAIQQAEDGLKEFDAGIIELKRRGDKLQVEQPSMQELSKLQDMYDELMMIIGSRRSGLNQNLTLKSQYERALQDLADLLETGQEKMAGDQKIIVSSKEEIQQLLDKHKEYFQGLESHMILTETLFRKIISFAVQKETQFHTELMAQASAVLKRAHKRGVELEYILETWSHLDEDQQELSRQLEVVESSIPSVGLVEENEDRLIDRITLYQHLKSSLNEYQPKLYQVLDDGKRLLISISCSDLESQLNQLGECWLSNTNKMSKELHRLETILKHWTRYQSESADLIHWLQSAKDRLEFWTQQSVTVPQELEMVRDHLNAFLEFSKEVDAQSSLKSSVLSTGNQLLRLKKVDTATLRSELSRIDSQWTDLLTNIPAVQEKLHQLQMDKLPSRHAISEVMSWISLMENVIQKDEDNIKNSIGYKAIHEYLQKYKGFKIDINCKQLTVDFVNQSVLQISSQDVESKRSDKTDFAEQLGAMNKSWQILQGLVTEKIQLLEGLLESWSEYENNVQCLKTWFETQEKRLKQQHRIGDQASVQNALKDCQDLEDLIKAKEKEVEKIEQNGLALIQNKKEDVSSIVMSTLRELGQTWANLDHMVGQLKILLKSVLDQWSSHKVAFDKINSYLMEARYSLSRFRLLTGSLEAVQVQVDNLQNLQDDLEKQERSLQKFGSITNQLLKECHPPVTETLTNTLKEVNMRWNNLLEEIAEQLQSSKALLQLWQRYKDYSKQCASTVQQQEDRTNELLKAATNKDIADDEVATWIQDCNDLLKGLGTVKDSLFFLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSDVMIPESPEAYVKLTENAIKNTSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 65080 - protein, 8749 aa, Homo sapiens
MATSRGASRCPRDIANVMQRLQDEQEIVQKRTFTKWINSHLAKRKPPMVVDDLFEDMKDGVKLLALLEVLSGQKLPCEQGRRMKRIHAVANIGTALKFLEGRKSMHRGSPIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDEILPGFPSFANSVQNFKREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEDIKTMEMVKTKWDHFGSNFETLSVWITEKEKELNALETSSSAMDMQISQIKVTIQEIESKLSSIVGLEEEAQSFAQFVTTGESARIKAKLTQIRRYGEELREHAQCLEGTILGHLSQQQKFEENLRKIQQSVSEFEDKLAVPIKICSSATETYKVLQEHMDLCQALESLSSAITAFSASARKVVNRDSCVQEAAALQQQYEDILRRAKERQTALENLLAHWQRLEKELSSFLTWLERGEAKASSPEMDISADRVKVEGELQLIQASSRKFVSQASFYSKLLQLKESLFSVASKDDVKMMKLHLEQLDERWRDLPQIINKRINFLQSVVAEHQQFDELLLSFSVWIKLFLSELQTTSEISIMDHQVALTRHKDHAAEVESKKGELQSLQGHLAKLGSLGRAEDLHLLQGKAEDCFQLFEEASQVVERRQLALSHLAEFLQSHASLSGILRQLRQTVEATNSMNKNESDLIEKDLNDALQNAKALESAAVSLDGILSKAQYHLKIGSSEQRTSCRATADQLCGEVERIQNLLGTKQSEADALAVLKKAFQDQKEELLKSIEDIEERTDKERLKEPTRQALQQRLRVFNQLEDELNSHEHELCWLKDKAKQIAQKDVAFAPEVDREINRLEVTWDDTKRLIHENQGQCCGLIDLMREYQNLKSAVSKVLENASSVIVTRTTIKDQEDLKWAFSKHETAKNKMNYKQKDLDNFTSKGKHLLSELKKIHSSDFSLVKTDMESTVDKWLDVSEKLEENMDRLRVSLSIWDDVLSTRDEIEGWSNNCVPQMAENISNLDNHLRAEELLKEFESEVKNKALRLEELHSKVNDLKELTKNLETPPDLQFIEADLMQKLEHAKEITEVAKGTLKDFTAQSTQVEKFINDITTWFTKVEESLMNCAQNETCEALKKVKDIQKELQSQQSNISSTQENLNSLCRKYHSAELESLGRAMTGLIKKHEAVSQLCSKTQASLQESLEKHFSESMQEFQEWFLGAKAAAKESSDRTGDSKVLEAKLHDLQNILDSVSDGQSKLDAVTQEGQTLYAHLSKQIVSSIQEQITKANEEFQAFLKQCLKDKQALQDCASELGSFEDQHRKLNLWIHEMEERFNTENLGESKQHIPEKKNEVHKVEMFLGELLAARESLDKLSQRGQLLSEEGHGAGQEGRLCSQLLTSHQNLLRMTKEKLRSCQVALQEHEALEEALQSMWFWVKAIQDRLACAESTLGSKDTLEKRLSQIQDILLMKGEGEVKLNMAIGKGEQALRSSNKEGQRVIQTQLETLKEVWADIMSSSVHAQSTLESVISQWNDYVERKNQLEQWMESVDQKIEHPLQPQPGLKEKFVLLDHLQSILSEAEDHTRALHRLIAKSRELYEKTEDESFKDTAQEELKTQFNDIMTVAKEKMRKVEEIVKDHLMYLDAVHEFTDWLHSAKEELHRWSDMSGDSSATQKKLSKIKELIDSREIGASRLSRVESLAPEVKQNTTASGCELMHTEMQALRADWKQWEDSVFQTQSCLENLVSQMALSEQEFSGQVAQLEQALEQFSALLKTWAQQLTLLEGKNTDEEIVECWHKGQEILDALQKAEPRTEDLKSQLNELCRFSRDLSTYSGKVSGLIKEYNCLCLQASKGCQNKEQILQQRFRKAFRDFQQWLVNAKITTAKCFDIPQNISEVSTSLQKIQEFLSESENGQHKLNMMLSKGELLSTLLTKEKAKGIQAKVTAAKEDWKNFHSNLHQKESALENLKIQMKDFEVSAEPIQDWLSKTEKMVHESSNRLYDLPAKRREQQKLQSVLEEIHCYEPQLNRLKEKAQQLWEGQAASKSFRHRVSQLSSQYLALSNLTKEKVSRLDRIVAEHNQFSLGIKELQDWMTDAIHMLDSYCHPTSDKSVLDSRTLKLEALLSVKQEKEIQMKMIVTRGESVLQNTSPEGIPTIQQQLQSVKDMWASLLSAGIRCKSQLEGALSKWTSYQDGVRQFSGWMDSMEANLNESERQHAELRDKTTMLGKAKLLNEEVLSYSSLLETIEVKGAGMTEHYVTQLELQDLQERYRAIQERAKEAVTKSEKLVRLHQEYQRDLKAFEVWLGQEQEKLDQYSVLEGDAHTHETTLRDLQELQVHCAEGQALLNSVLHTREDVIPSGIPQAEDRALESLRQDWQAYQHRLSETRTQFNNVVNKLRLMEQKFQQVDEWLKTAEEKKWHEEVTAYRDEVEEVGARAQEILDESHVNSRMGCQATQLTSRYQALLLQVLEQIKFLEEEIQSLEESESSLSSYSDWYGSTHKNFKNVATKIDKVDTVMMGKKLKTLEVLLKDMEKGHSLLKSAREKGERAVKYLEEGEAERLRKEIHDHMEQLKELTSTVRKEHMTLEKGLHLAKEFSDKCKALTQWIAEYQEILHVPEEPKMELYEKKAQLSKYKSLQQTVLSHEPSVKSVREKGEALLELVQDVTLKDKIDQLQSDYQDLCSIGKAMMEEIAGFEDRLNNLQMKGDTLIGQCADHLQAKLKQNVHAHLQGTKDSYSAICSTAQRMYQSLEHELQKHVSRQDTLQQCQAWLSAVQPDLEPSPQPPLSRAEAIKQVKHFRALQEQARTYLDLLCSMCDLSNASVKTTAKDIQQTEQTIEQKLVQAQNLTQGWEEIKHLKSELWIYLQDADQQLQNMKRRHSELELNIAQNMVSQVKDFVKKLQSKQASVNTIIEKVNKLTKKEESPEHKEINHLNDQWLDLCRQSNNLCLQREEDLQRTRDYHDCMNVVEVFLEKFTTEWDNLARSDAESTAVHLEALKKLALALQERKYAIEDLKDQKQKMIEHLNLDDKELVKEQTSHLEQRWFQLEDLIKRKIQVSVTNLEELNVVQSRFQELMEWAEEQQPNIAEALKQSPPPDMAQNLLMDHLAICSELEAKQMLLKSLIKDADRVMADLGLNERQVIQKALSDAQSHVNCLSDLVGQRRKYLNKALSEKTQFLMAVFQATSQIQQHERKIMFREHICLLPDDVSKQVKTCKSAQASLKTYQNEVTGLWAQGRELMKEVTEQEKSEVLGKLQELQSVYDSVLQKCSHRLQELEKNLVSRKHFKEDFDKACHWLKQADIVTFPEINLMNESSELHTQLAKYQNILEQSPEYENLLLTLQRTGQTILPSLNEVDHSYLSEKLNALPRQFNVIVALAKDKFYKVQEAILARKEYASLIELTTQSLSELEAQFLRMSKVPTDLAVEEALSLQDGCRAILDEVAGLGEAVDELNQKKEGFRSTGQPWQPDKMLHLVTLYHRLKRQTEQRVSLLEDTTSAYQEHEKMCQQLERQLKSVKEEQSKVNEETLPAEEKLKMYHSLAGSLQDSGIVLKRVTIHLEDLAPHLDPLAYEKARHQIQSWQGELKLLTSAIGETVTECESRMVQSIDFQTEMSRSLDWLRRVKAELSGPVYLDLNLQDIQEEIRKIQIHQEEVQSSLRIMNALSHKEKEKFTKAKELISADLEHSLAELSELDGDIQEALRTRQATLTEIYSQCQRYYQVFQAANDWLEDAQELLQLAGNGLDVESAEENLKSHMEFFSTEDQFHSNLEELHSLVATLDPLIKPTGKEDLEQKVASLELRSQRMSRDSGAQVDLLQRCTAQWHDYQKAREEVIELMNDTEKKLSEFSLLKTSSSHEAEEKLSEHKALVSVVNSFHEKIVALEEKASQLEKTGNDASKATLSRSMTTVWQRWTRLRAVAQDQEKILEDAVDEWTGFNNKVKKATEMIDQLQDKLPGSSAEKASKAELLTLLEYHDTFVLELEQQQSALGMLRQQTLSMLQDGAAPTPGEEPPLMQEITAMQDRCLNMQEKVKTNGKLVKQELKDREMVETQINSVKCWVQETKEYLGNPTIEIDAQLEELQILLTEATNHRQNIEKMAEEQKEKYLGLYTILPSELSLQLAEVALDLKIRDQIQDKIKEVEQSKATSQELSRQIQKLAKDLTTILTKLKAKTDNVVQAKTDQKVLGEELDGCNSKLMELDAAVQKFLEQNGQLGKPLAKKIGKLTELHQQTIRQAENRLSKLNQAASHLEEYNEMLELILKWIEKAKVLAHGTIAWNSASQLREQYILHQTLLEESKEIDSELEAMTEKLQYLTSVYCTEKMSQQVAELGRETEELRQMIKIRLQNLQDAAKDMKKFEAELKKLQAALEQAQATLTSPEVGRLSLKEQLSHRQHLLSEMESLKPKVQAVQLCQSALRIPEDVVASLPLCHAALRLQEEASRLQHTAIQQCNIMQAAVVQYEQYEQEMKHLQQLIEGAHREIEDKPVATSNIQELQAQISRHEELAQKIKGYQEQIASLNSKCKMLTMKAKHATMLLTVTEVEGLAEGTEDLDGELLPTPSAHPSVVMMTAGRCHTLLSPVTEESGEEGTNSEISSPPACRSPSPVANTDASVNQDIAYYQALSAERLQTDAAKIHPSTSASQEFYEPGLEPSATAKLGDLQRSWETLKNVISEKQRTLYEALERQQKYQDSLQSISTKMEAIELKLSESPEPGRSPESQMAEHQALMDEILMLQDEINELQSSLAEELVSESCEADPAEQLALQSTLTVLAERMSTIRMKASGKRQLLEEKLNDQLEEQRQEQALQRYRCEADELDSWLLSTKATLDTALSPPKEPMDMEAQLMDCQNMLVEIEQKVVALSELSVHNENLLLEGKAHTKDEAEQLAGKLRRLKGSLLELQRALHDKQLNMQGTAQEKEESDVDLTATQSPGVQEWLAQARTTWTQQRQSSLQQQKELEQELAEQKSLLRSVASRGEEILIQHSAAETSGDAGEKPDVLSQELGMEGEKSSAEDQMRMKWESLHQEFSTKQKLLQNVLEQEQEQVLYSRPNRLLSGVPLYKGDVPTQDKSAVTSLLDGLNQAFEEVSSQSGGAKRQSIHLEQKLYDGVSATSTWLDDVEERLFVATALLPEETETCLFNQEILAKDIKEMSEEMDKNKNLFSQAFPENGDNRDVIEDTLGCLLGRLSLLDSVVNQRCHQMKERLQQILNFQNDLKVLFTSLADNKYIILQKLANVFEQPVAEQIEAIQQAEDGLKEFDAGIIELKRRGDKLQVEQPSMQELSKLQDMYDELMMIIGSRRSGLNQNLTLKSQYERALQDLADLLETGQEKMAGDQKIIVSSKEEIQQLLDKHKEYFQGLESHMILTETLFRKIISFAVQKETQFHTELMAQASAVLKRAHKRGVELEYILETWSHLDEDQQELSRQLEVVESSIPSVGLVEENEDRLIDRITLYQHLKSSLNEYQPKLYQVLDDGKRLLISISCSDLESQLNQLGECWLSNTNKMSKELHRLETILKHWTRYQSESADLIHWLQSAKDRLEFWTQQSVTVPQELEMVRDHLNAFLEFSKEVDAQSSLKSSVLSTGNQLLRLKKVDTATLRSELSRIDSQWTDLLTNIPAVQEKLHQLQMDKLPSRHAISEVMSWISLMENVIQKDEDNIKNSIGYKAIHEYLQKYKGFKIDINCKQLTVDFVNQSVLQISSQDVESKRSDKTDFAEQLGAMNKSWQILQGLVTEKIQLLEGLLESWSEYENNVQCLKTWFETQEKRLKQQHRIGDQASVQNALKDCQDLEDLIKAKEKEVEKIEQNGLALIQNKKEDVSSIVMSTLRELGQTWANLDHMVGQLKILLKSVLDQWSSHKVAFDKINSYLMEARYSLSRFRLLTGSLEAVQVQVDNLQNLQDDLEKQERSLQKFGSITNQLLKECHPPVTETLTNTLKEVNMRWNNLLEEIAEQLQSSKALLQLWQRYKDYSKQCASTVQQQEDRTNELLKAATNKDIADDEVATWIQDCNDLLKGLGTVKDSLFFLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSDVMIPESPEAYVKLTENAIKNTSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 65081 - protein, 952 aa, Homo sapiens
MVVAEDLSALRMAEDSCVDADLPDCNCDVTRVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 65082 - protein, 6824 aa, Homo sapiens
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKIPRLLEPEDVDVVDPDEKSIMTYVAQFLQYSKDAPGTGEEAQGKVKDAMGWLTLQKEKLQKLLKDSENDTYFKKYNSLLSFMESFNEEKKSFLDVLSIKRDLDELDKDHLQLREAWDGLDHQINAWKIKLNYALPPPLHQTEAWLQEVEELMDEDLSASQDHSQAVTLIQEKMTLFKSLMDRFEHHSNILLTFENKDENHLPLVPPNKLEEMKRRINNILEKKFILLLEFHYYKCLVLGLVDEVKSKLDIWNIKYGSRESVELLLEDWHKFIEEKEFLARLDTSFQKCGEIYKNLAGECQNINKQYMMVKSDVCMYRKNIYNVKSTLQKVLACWATYVENLRLLRACFEETKKEEIKEVPFETLAQWNLEHATLNEAGNFLVEVSNDVVGSSISKELRRLNKRWRKLVSKTQLEMNLPLMIKKQDQPTFDNSGNILSKEEKATVEFSTDMSVELPENYNQNIKAGEKHEKENEEFTGQLKVAKDVEKLIGQVEIWEAEAKSVLDQDDVDTSMEESLKHLIAKGSMFDELMARSEDMLQMDIQNISSQESFQHVLTTGLQAKIQEAKEKVQINVVKLIAALKNLTDVSPDLDIRLKMEESQKELESYMMRAQQLLGQRESPGELISKHKEALIISNTKSLAKYLKAVEELKNNVTEDIKMSLEEKSRDVCAKWESLHHELSLYVQQLKIDIEKGKLSDNILKLEKQINKEKKLIRRGRTKGLIKEHEACFSEEGCLYQLNHHMEVLRELCEELPSQKSQQEVKRLLKDYEQKIERLLKCASEIHMTLQPTAGGTSKNEGTITTSENRGGDPHSEAPFAKSDNQPSTEKAMEPTMKFSLASVLRPLQEESIMEKDYSASINSLLERYDTYRDILEHHLQNNKFRITSDFSSEEDRSSSCLQAKLTDLQVIKNETDARWKEFEIISLKLENHVNDIKKPFVIKERDTLKERERELQMTLNTRMESLETALRLVLPVEKASLLLCGSDLPLHKMAIQGFHLIDADRIYQHLRNIQDSIAKQIEICNRLEEPGNFVLKELHPFDLHAMQNIILKYKTQFEGMNHRVQRSEDTLKALEDFLASLRTAKLSAEPVTDLSASDTQVAQENTLTVKNKEGEIHLMKDKAKHLDKCLKMLDMSFKDAERGDDTSCENLLDAFSIKLSETHGYGVQEEFTEENKLLEACIFKNNELLKNIQDVQSQISKIGLKDPTVPAVKHRKKSLIRLDKVLDEYEEEKRHLQEMANSLPHFKDGREKTVNQQCQNTVVLWENTKALVTECLEQCGRVLELLKQYQNFKSILTTLIQKEESVISLQASYMGKENLKKRIAEIEIVKEEFNEHLEVVDKINQVCKNLQFYLNKMKTFEEPPFEKEANIIVDRWLDINEKTEDYYENLGRALALWDKLFNLKNVIDEWTEKALQKMELHQLTEEDRERLKEELQVHEQKTSEFSRRVAEIQFLLQSSEIPLELQVMESSILNKMEHVQKCLTGESNCHALSGSTAELREDLDQAKTQIGMTESLLKALSPSDSLEIFTKLEEIQQQILQQKHSMILLENQIGCLTPELSELKKQYESVSDLFNTKKSVLQDHFSKLLNDQCKNFNDWFSNIKVNLKECFESSETKKSVEQKLQKLSDFLTLEGRNSKIKQVDSVLKHVKKHLPKAHVKELISWLVGQEFELEKMESICQARAKELEDSLQQLLRLQDDHRNLRKWLTNQEEKWKGMEEPGEKTELFCQALARKREQFESVAQLNNSLKEYGFTEEEEIIMEATCLMDRYQTLLRQLSEIEEEDKLLPTEDQSFNDLAHDVIHWIKEIKESLMVLNSSEGKMPLEERIQKIKEIILLKPEGDARIETIMKQAESSEAPLVQKTLTDISNQWDNTLHLASTYLSHQEKLLLEGEKYLQSKEDLRLMLIELKKKQEAGFALQHGLQEKKAQLKIYKKFLKKAQDLTSLLKELKSQGNYLLECTKNPSFSEEPWLEIKHLHESLLQQLQDSVQNLDGHVREHDSYQVCVTDLNTTLDNFSKEFVSFSDKPVDQIAVEEKLQKLQELENRLSLQDGTLKKILALAKSVKQNTSSVGQKIIKDDIKSLQCKQKDLENRLASAKQEMECCLNSILKSKRSTEKKGKFTLPGREKQATSDVQESTQESAAVEKLEEDWEINKNFVENVMAVSKNCHHSMYIFESIVKNFISDEMQDSAVEMAMSKQLSLNAQESMKNTEDERKVNELQNQPLELDTMLRNEQLEEIEKLYTQLEAKKAAIKPLEQTECLNKTETGALVLHNIGYSAQHLDNLLQALITLKKNKESQYCVLRDFQEYLAAVESSMKALLTDKESLKVGPLDSVTYLDKIKKFIASIEKEKDSLGNLKIKWENLSNHVTDMDKKLLESQIKQLEHGWEQVEQQIQKKYSQQVVEYDEFTTLMNKVQDTEISLQQQQQHLQLRLKSPEERAGNQSMIALTTDLQATKHGFSVLKGQAELQMKRIWGEKEKKNLEDGINNLKKQWETLEPLHLEAENQIKKCDIRNKMKETILWAKNLLGELNPSIPLLPDDILSQIRKCKVTHDGILARQQSVESLAEEVKDKVPSLTTYEGSDLNNTLEDLRNQYQMLVLKSTQRSQQLEFKLEERSNFFAIIRKFQLMVQESETLIIPRVETAATEAELKHHHVTLEASQKELQEIDSGISTHLQELTNIYEELNVFERLFLEDQLKNLKIRTNRIQRFIQNTCNEVEHKIKFCRQFHEKTSALQEEADSIQRNELLLNQEVNKGVKEEIYNLKDRLTAIKCCILQVLKLKKVFDYIGLNWDFSQLDQLQTQVFEKEKELEEKIKQLDTFEEEHGKYQALLSKMRAIDLQIKKMTEVVLKAPDSSPESRRLNAQILSQRIEKAKCLCDEIIKKLNENKTFDDSFKEKEILQIKLNAEENDKLYKVLQNMVLELSPKELDEKNCQDKLETSLHVLNQIKSQLQQPLLINLEIKHIQNEKDNCEAFQEQVWAEMCSIKAVTAIEKQREENSSEASDVETKLREFEDLQMQLNTSIDLRTNVLNDAYENLTRYKEAVTRAVESITSLEAIIIPYRVDVGNPEESLEMPLRKQEELESTVAHIQDLTEKLGMISSPEAKLQLQYTLQELVSKNSAMKEAFKAQETEAERYLENYKCYRKMEEDIYTNLSKMETVLGQSMSSLPLSYREALERLEQSKALVSNLISTKEELMKLRQILRLLRLRCTENDGICLLKIVSALWEKWLSLLEAAKEWEMWCEELKQEWKFVSEEIEREAIILDNLQEELPEISKTKEAATTEELSELLDCLCQYGENVEKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSARYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLRSAFLGVYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFENHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLNAHVARCGGASLKKQDLRYSLHTACGAALLCRSSHGANKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKVAIRKQEIEDRLNTWVVFNEKNKELCAWLVQMENKVLQTADISIEEMIEKLQKRTVGREEVPERWECETIVSGHGTEESCFLSIRKFHQGRGLHILTCQLIPQDCMEEINLFSENKLQLKQMGDQLIKASNKSRAAEIDDKLNKINDRWQHLFDVIGSSMADQTNSRWMFFQWPRGIQRTVTWPWDHLCSCASTGHTGPFHSSVLRCFEQHIEFGIYRRTYKVNKELGGDKNGQRCPIIYPHGLVQCIRLGEPLILKRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFERQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYVSLNFTGSTAYVCAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKFLYPAVQSSENYRRRGGDREQGPRQHTATALLPLKGGPGSPTPAAAPPAAAAPGLPAALLRRRLQLHSGQQLCPVLLPHAEVHQWATPHIEGIAGHSATPPA

SEQ ID NO: 65083 - protein, 6885 aa, Homo sapiens
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKIPRLLEPEDVDVVDPDEKSIMTYVAQFLQYSKDAPGTGEEAQGKVKDAMGWLTLQKEKLQKLLKDSENDTYFKKYNSLLSFMESFNEEKKSFLDVLSIKRDLDELDKDHLQLREAWDGLDHQINAWKIKLNYALPPPLHQTEAWLQEVEELMDEDLSASQDHSQAVTLIQEKMTLFKSLMDRFEHHSNILLTFENKDENHLPLVPPNKLEEMKRRINNILEKKFILLLEFHYYKCLVLGLVDEVKSKLDIWNIKYGSRESVELLLEDWHKFIEEKEFLARLDTSFQKCGEIYKNLAGECQNINKQYMMVKSDVCMYRKNIYNVKSTLQKVLACWATYVENLRLLRACFEETKKEEIKEVPFETLAQWNLEHATLNEAGNFLVEVSNDVVGSSISKELRRLNKRWRKLVSKTQLEMNLPLMIKKQDQPTFDNSGNILSKEEKATVEFSTDMSVELPENYNQNIKAGEKHEKENEEFTGQLKVAKDVEKLIGQVEIWEAEAKSVLDQDDVDTSMEESLKHLIAKGSMFDELMARSEDMLQMDIQNISSQESFQHVLTTGLQAKIQEAKEKVQINVVKLIAALKNLTDVSPDLDIRLKMEESQKELESYMMRAQQLLGQRESPGELISKHKEALIISNTKSLAKYLKAVEELKNNVTEDIKMSLEEKSRDVCAKWESLHHELSLYVQQLKIDIEKGKLSDNILKLEKQINKEKKLIRRGRTKGLIKEHEACFSEEGCLYQLNHHMEVLRELCEELPSQKSQQEVKRLLKDYEQKIERLLKCASEIHMTLQPTAGGTSKNEGTITTSENRGGDPHSEAPFAKSDNQPSTEKAMEPTMKFSLASVLRPLQEESIMEKDYSASINSLLERYDTYRDILEHHLQNNKFRITSDFSSEEDRSSSCLQAKLTDLQVIKNETDARWKEFEIISLKLENHVNDIKKPFVIKERDTLKERERELQMTLNTRMESLETALRLVLPVEKASLLLCGSDLPLHKMAIQGFHLIDADRIYQHLRNIQDSIAKQIEICNRLEEPGNFVLKELHPFDLHAMQNIILKYKTQFEGMNHRVQRSEDTLKALEDFLASLRTAKLSAEPVTDLSASDTQVAQENTLTVKNKEGEIHLMKDKAKHLDKCLKMLDMSFKDAERGDDTSCENLLDAFSIKLSETHGYGVQEEFTEENKLLEACIFKNNELLKNIQDVQSQISKIGLKDPTVPAVKHRKKSLIRLDKVLDEYEEEKRHLQEMANSLPHFKDGREKTVNQQCQNTVVLWENTKALVTECLEQCGRVLELLKQYQNFKSILTTLIQKEESVISLQASYMGKENLKKRIAEIEIVKEEFNEHLEVVDKINQVCKNLQFYLNKMKTFEEPPFEKEANIIVDRWLDINEKTEDYYENLGRALALWDKLFNLKNVIDEWTEKALQKMELHQLTEEDRERLKEELQVHEQKTSEFSRRVAEIQFLLQSSEIPLELQVMESSILNKMEHVQKCLTGESNCHALSGSTAELREDLDQAKTQIGMTESLLKALSPSDSLEIFTKLEEIQQQILQQKHSMILLENQIGCLTPELSELKKQYESVSDLFNTKKSVLQDHFSKLLNDQCKNFNDWFSNIKVNLKECFESSETKKSVEQKLQKLSDFLTLEGRNSKIKQVDSVLKHVKKHLPKAHVKELISWLVGQEFELEKMESICQARAKELEDSLQQLLRLQDDHRNLRKWLTNQEEKWKGMEEPGEKTELFCQALARKREQFESVAQLNNSLKEYGFTEEEEIIMEATCLMDRYQTLLRQLSEIEEEDKLLPTEDQSFNDLAHDVIHWIKEIKESLMVLNSSEGKMPLEERIQKIKEIILLKPEGDARIETIMKQAESSEAPLVQKTLTDISNQWDNTLHLASTYLSHQEKLLLEGEKYLQSKEDLRLMLIELKKKQEAGFALQHGLQEKKAQLKIYKKFLKKAQDLTSLLKELKSQGNYLLECTKNPSFSEEPWLEIKHLHESLLQQLQDSVQNLDGHVREHDSYQVCVTDLNTTLDNFSKEFVSFSDKPVDQIAVEEKLQKLQELENRLSLQDGTLKKILALAKSVKQNTSSVGQKIIKDDIKSLQCKQKDLENRLASAKQEMECCLNSILKSKRSTEKKGKFTLPGREKQATSDVQESTQESAAVEKLEEDWEINKDSAVEMAMSKQLSLNAQESMKNTEDERKVNELQNQPLELDTMLRNEQLEEIEKLYTQLEAKKAAIKPLEQTECLNKTETGALVLHNIGYSAQHLDNLLQALITLKKNKESQYCVLRDFQEYLAAVESSMKALLTDKESLKVGPLDSVTYLDKIKKFIASIEKEKDSLGNLKIKWENLSNHVTDMDKKLLESQIKQLEHGWEQVEQQIQKKYSQQVVEYDEFTTLMNKVQDTEISLQQQQQHLQLRLKSPEERAGNQSMIALTTDLQATKHGFSVLKGQAELQMKRIWGEKEKKNLEDGINNLKKQWETLEPLHLEAENQIKKCDIRNKMKETILWAKNLLGELNPSIPLLPDDILSQIRKCKVTHDGILARQQSVESLAEEVKDKVPSLTTYEGSDLNNTLEDLRNQYQMLVLKSTQRSQQLEFKLEERSNFFAIIRKFQLMVQESETLIIPRVETAATEAELKHHHVTLEASQKELQEIDSGISTHLQELTNIYEELNVFERLFLEDQLKNLKIRTNRIQRFIQNTCNEVEHKIKFCRQFHEKTSALQEEADSIQRNELLLNQEVNKGVKEEIYNLKDRLTAIKCCILQVLKLKKVFDYIGLNWDFSQLDQLQTQVFEKEKELEEKIKQLDTFEEEHGKYQALLSKMRAIDLQIKKMTEVVLKAPDSSPESRRLNAQILSQRIEKAKCLCDEIIKKLNENKTFDDSFKEKEILQIKLNAEENDKLYKVLQNMVLELSPKELDEKNCQDKLETSLHVLNQIKSQLQQPLLINLEIKHIQNEKDNCEAFQEQVWAEMCSIKAVTAIEKQREENSSEASDVETKLREFEDLQMQLNTSIDLRTNVLNDAYENLTRYKEAVTRAVESITSLEAIIIPYRVDVGNPEESLEMPLRKQEELESTVAHIQDLTEKLGMISSPEAKLQLQYTLQELVSKNSAMKEAFKAQETEAERYLENYKCYRKMEEDIYTNLSKMETVLGQSMSSLPLSYREALERLEQSKALVSNLISTKEELMKLRQILRLLRLRCTENDGICLLKIVSALWEKWLSLLEAAKEWEMWCEELKQEWKFVSEEIEREAIILDNLQEELPEISKTKEAATTEELSELLDCLCQYGENVEKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTMYNFRYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQNEIKRLYHQLIKSKTSLQQSLNEISGQSVAEQLQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKQFRAVRTTEGEEETESRVPGSTRPQRSFLSRVVRAALPLQLLLLLLLLLACLLPSSEEDYSCTQANNFARSFYPMLRYTNGPPPT

SEQ ID NO: 65084 - protein, 267 aa, Homo sapiens
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKIPRLLEPEAYKNF

SEQ ID NO: 65085 - protein, 3270 aa, Homo sapiens
MEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQDSKCFRSGPRPNIYVSYYVTVIQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTMYNFRYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQNEIKRLYHQLIKSKTSLQQSLNEISGQSVAEQLQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKQFRAVRTTEGEEETESRVPGSTRPQRSFLSRVVRAALPLQLLLLLLLLLACLLPSSEEDYSCTQANNFARSFYPMLRYTNGPPPT

SEQ ID NO: 65086 - protein, 6907 aa, Homo sapiens
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKIPRLLEPEDVDVVDPDEKSIMTYVAQFLQYSKDAPGTGEEAQGKVKDAMGWLTLQKEKLQKLLKDSENDTYFKKYNSLLSFMESFNEEKKSFLDVLSIKRDLDELDKDHLQLREAWDGLDHQINAWKIKLNYALPPPLHQTEAWLQEVEELMDEDLSASQDHSQAVTLIQEKMTLFKSLMDRFEHHSNILLTFENKDENHLPLVPPNKLEEMKRRINNILEKKFILLLEFHYYKCLVLGLVDEVKSKLDIWNIKYGSRESVELLLEDWHKFIEEKEFLARLDTSFQKCGEIYKNLAGECQNINKQYMMVKSDVCMYRKNIYNVKSTLQKVLACWATYVENLRLLRACFEETKKEEIKEVPFETLAQWNLEHATLNEAGNFLVEVSNDVVGSSISKELRRLNKRWRKLVSKTQLEMNLPLMIKKQDQPTFDNSGNILSKEEKATVEFSTDMSVELPENYNQNIKAGEKHEKENEEFTGQLKVAKDVEKLIGQVEIWEAEAKSVLDQDDVDTSMEESLKHLIAKGSMFDELMARSEDMLQMDIQNISSQESFQHVLTTGLQAKIQEAKEKVQINVVKLIAALKNLTDVSPDLDIRLKMEESQKELESYMMRAQQLLGQRESPGELISKHKEALIISNTKSLAKYLKAVEELKNNVTEDIKMSLEEKSRDVCAKWESLHHELSLYVQQLKIDIEKGKLSDNILKLEKQINKEKKLIRRGRTKGLIKEHEACFSEEGCLYQLNHHMEVLRELCEELPSQKSQQEVKRLLKDYEQKIERLLKCASEIHMTLQPTAGGTSKNEGTITTSENRGGDPHSEAPFAKSDNQPSTEKAMEPTMKFSLASVLRPLQEESIMEKDYSASINSLLERYDTYRDILEHHLQNNKFRITSDFSSEEDRSSSCLQAKLTDLQVIKNETDARWKEFEIISLKLENHVNDIKKPFVIKERDTLKERERELQMTLNTRMESLETALRLVLPVEKASLLLCGSDLPLHKMAIQGFHLIDADRIYQHLRNIQDSIAKQIEICNRLEEPGNFVLKELHPFDLHAMQNIILKYKTQFEGMNHRVQRSEDTLKALEDFLASLRTAKLSAEPVTDLSASDTQVAQENTLTVKNKEGEIHLMKDKAKHLDKCLKMLDMSFKDAERGDDTSCENLLDAFSIKLSETHGYGVQEEFTEENKLLEACIFKNNELLKNIQDVQSQISKIGLKDPTVPAVKHRKKSLIRLDKVLDEYEEEKRHLQEMANSLPHFKDGREKTVNQQCQNTVVLWENTKALVTECLEQCGRVLELLKQYQNFKSILTTLIQKEESVISLQASYMGKENLKKRIAEIEIVKEEFNEHLEVVDKINQVCKNLQFYLNKMKTFEEPPFEKEANIIVDRWLDINEKTEDYYENLGRALALWDKLFNLKNVIDEWTEKALQKMELHQLTEEDRERLKEELQVHEQKTSEFSRRVAEIQFLLQSSEIPLELQVMESSILNKMEHVQKCLTGESNCHALSGSTAELREDLDQAKTQIGMTESLLKALSPSDSLEIFTKLEEIQQQILQQKHSMILLENQIGCLTPELSELKKQYESVSDLFNTKKSVLQDHFSKLLNDQCKNFNDWFSNIKVNLKECFESSETKKSVEQKLQKLSDFLTLEGRNSKIKQVDSVLKHVKKHLPKAHVKELISWLVGQEFELEKMESICQARAKELEDSLQQLLRLQDDHRNLRKWLTNQEEKWKGMEEPGEKTELFCQALARKREQFESVAQLNNSLKEYGFTEEEEIIMEATCLMDRYQTLLRQLSEIEEEDKLLPTEDQSFNDLAHDVIHWIKEIKESLMVLNSSEGKMPLEERIQKIKEIILLKPEGDARIETIMKQAESSEAPLVQKTLTDISNQWDNTLHLASTYLSHQEKLLLEGEKYLQSKEDLRLMLIELKKKQEAGFALQHGLQEKKAQLKIYKKFLKKAQDLTSLLKELKSQGNYLLECTKNPSFSEEPWLEIKHLHESLLQQLQDSVQNLDGHVREHDSYQVCVTDLNTTLDNFSKEFVSFSDKPVDQIAVEEKLQKLQELENRLSLQDGTLKKILALAKSVKQNTSSVGQKIIKDDIKSLQCKQKDLENRLASAKQEMECCLNSILKSKRSTEKKGKFTLPGREKQATSDVQESTQESAAVEKLEEDWEINKDSAVEMAMSKQLSLNAQESMKNTEDERKVNELQNQPLELDTMLRNEQLEEIEKLYTQLEAKKAAIKPLEQTECLNKTETGALVLHNIGYSAQHLDNLLQALITLKKNKESQYCVLRDFQEYLAAVESSMKALLTDKESLKVGPLDSVTYLDKIKKFIASIEKEKDSLGNLKIKWENLSNHVTDMDKKLLESQIKQLEHGWEQVEQQIQKKYSQQVVEYDEFTTLMNKVQDTEISLQQQQQHLQLRLKSPEERAGNQSMIALTTDLQATKHGFSVLKGQAELQMKRIWGEKEKKNLEDGINNLKKQWETLEPLHLEAENQIKKCDIRNKMKETILWAKNLLGELNPSIPLLPDDILSQIRKCKVTHDGILARQQSVESLAEEVKDKVPSLTTYEGSDLNNTLEDLRNQYQMLVLKSTQRSQQLEFKLEERSNFFAIIRKFQLMVQESETLIIPRVETAATEAELKHHHVTLEASQKELQEIDSGISTHLQELTNIYEELNVFERLFLEDQLKNLKIRTNRIQRFIQNTCNEVEHKIKFCRQFHEKTSALQEEADSIQRNELLLNQEVNKGVKEEIYNLKDRLTAIKCCILQVLKLKKVFDYIGLNWDFSQLDQLQTQVFEKEKELEEKIKQLDTFEEEHGKYQALLSKMRAIDLQIKKMTEVVLKAPDSSPESRRLNAQILSQRIEKAKCLCDEIIKKLNENKTFDDSFKEKEILQIKLNAEENDKLYKVLQNMVLELSPKELDEKNCQDKLETSLHVLNQIKSQLQQPLLINLEIKHIQNEKDNCEAFQEQVWAEMCSIKAVTAIEKQREENSSEASDVETKLREFEDLQMQLNTSIDLRTNVLNDAYENLTRYKEAVTRAVESITSLEAIIIPYRVDVGNPEESLEMPLRKQEELESTVAHIQDLTEKLGMISSPEAKLQLQYTLQELVSKNSAMKEAFKAQETEAERYLENYKCYRKMEEDIYTNLSKMETVLGQSMSSLPLSYREALERLEQSKALVSNLISTKEELMKLRQILRLLRLRCTENDGICLLKIVSALWEKWLSLLEAAKEWEMWCEELKQEWKFVSEEIEREAIILDNLQEELPEISKTKEAATTEELSELLDCLCQYGENVEKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTMYNFRYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQNEIKRLYHQLIKSKTSLQQSLNEISGQSVAEQLQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKFRAVRTTEGEEETESRVPGSTRPQRSFLSRVVRAALPLQLLLLLLLLLACLLPSSEEDYSCTQANNFARSFYPMLRYTNGPPPT

SEQ ID NO: 65087 - protein, 3270 aa, Homo sapiens; identical to SEQ ID NO: 65085

SEQ ID NO: 65088 - protein, 429 aa, Homo sapiens
MEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQGSKTRPRSDVLFFKDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKFRAVRTTEGEEETESRVPGSTRPQRSFLSRVVRAALPLQLLLLLLLLLACLLPSSEEDYSCTQANNFARSFYPMLRYTNGPPPT

SEQ ID NO: 65089 - protein, 556 aa, Homo sapiens
MEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQGSKTRPRSDVLFFKDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKQFRAVRTTEGEEETESRVPGSTRPQRSFLSRVVRAALPLQLLLLLLLLLACLLPSSEEDYSCTQANNFARSFYPMLRYTNGPPPT

SEQ ID NO: 65090 - protein, 668 aa, Homo sapiens
MVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKQFRAVRTTEGEEETESRVPGSTRPQRSFLSRVVRAALPLQLLLLLLLLLACLLPSSEEDYSCTQANNFARSFYPMLRYTNGPPPT

SEQ ID NO: 65091 - protein, 3541 aa, Homo sapiens
MEEDIYTNLSKMETVLGQSMSSLPLSYREALERLEQSKALVSNLISTKEELMKLRQILRLLRLRCTENDGICLLKIVSALWEKWLSLLEAAKEWEMWCEELKQEWKFVSEEIEREAIILDNLQEELPEISKTKEAATTEELSELLDCLCQYGENVEKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTMYNFRYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQNEIKRLYHQLIKSKTSLQQSLNEISGQSVAEQLQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKFRAVRTTEGEEETESRVPGSTRPQRSFLSRVVRAALPLQLLLLLLLLLACLLPSSEEDYSCTQANNFARSFYPMLRYTNGPPPT

SEQ ID NO: 65092 - protein, 763 aa, Homo sapiens
MSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKQFRAVRTTEGEEETESRVPGSTRPQRSFLSRVVRAALPLQLLLLLLLLLACLLPSSEEDYSCTQANNFARSFYPMLRYTNGPPPT

SEQ ID NO: 65093 - protein, 2416 aa, Homo sapiens
MEQFPKETVVESSGPKVLETAEEIQERRQEVLTRYQSFKERVAERGQKLEDSYHLQVFKRDADDLGKWIMEKVNILTDKSYEDPTNIQGKYQKHQSLEAEVQTKSRLMSELEKTREERFTMGHSAHEETKAHIEELRHLWDLLLELTLEKGDQLLRALKFQQYVQECADILEWIGDKEAIATSVELGEDWERTEVLHKKFEDFQVELVAKEGRVVEVNQYANECAEENHPDLPLIQSKQNEVNAAWERLRGLALQRQKALSNAANLQRFKRDVTEAIQWIKEKEPVLTSEDYGKDLVASEGLFHSHKGLERNLAVMSDKVKELCAKAEKLTLSHPSDAPQIQEMKEDLVSSWEHIRALATSRYEKLQATYWYHRFSSDFDELSGWMNEKTAAINADELPTDVAGGEVLLDRHQQHKHEIDSYDDRFQSADETGQDLVNANHEASDEVREKMEILDNNWTALLELWDERHRQYEQCLDFHLFYRDSEQVDSWMSRQEAFLENEDLGNSLGSAEALLQKHEDFEEAFTAQEEKIITVDKTATKLIGDDHYDSENIKAIRDGLLARRDALREKAATRRRLLKESLLLQKLYEDSDDLKNWINKKKKLADDEDYKDIQNLKSRVQKQQVFEKELAVNKTQLENIQKTGQEMIEGGHYASDNVTTRLSEVASLWEELLEATKQKGTQLHEANQQLQFENNAEDLQRWLEDVEWQVTSEDYGKGLAEVQNRLRKHGLLESAVAARQDQVDILTDLAAYFEEIGHPDSKDIRARQESLVCRFEALKEPLATRKKKLLDLLHLQLICRDTEDEEAWIQETEPSATSTYLGKDLIASKKLLNRHRVILENIASHEPRIQEITERGNKMVEEGHFAAEDVASRVKSLNQNMESLRARAARRQNDLEANVQFQQYLADLHEAETWIREKEPIVDNTNYGADEEAAGALLKKHEAFLLDLNSFGDSMKALRNQANACQQQQAAPVEGVAGEQRVMALYDFQARSPREVTMKKGDVLTLLSSINKDWWKVEAADHQGIVPAVYVRRLAHDEFPMLPQRRREEPGNITQRQEQIENQYRSLLDRAEERRRRLLQRYNEFLLAYEAGDMLEWIQEKKAENTGVELDDVWELQKKFDEFQKDLNTNEPRLRDINKVADDLLFEGLLTPEGAQIRQELNSRWGSLQRLADEQRQLLGSAHAVEVFHREADDTKEQIEKKCQALSAADPGSDLFSVQALQRRHEGFERDLVPLGDKVTILGETAERLSESHPDATEDLQRQKMELNEAWEDLQGRTKDRKESLNEAQKFYLFLSKARDLQNWISSIGGMVSSQELAEDLTGIEILLERHQEHRADMEAEAPTFQALEDFSAELIDSGHHASPEIEKKLQAVKLERDDLEKAWEKRKKILDQCLELQMFQGNCDQVESWMVARENSLRSDDKSSLDSLEALMKKRDDLDKAITAQEGKITDLEHFAESLIADEHYAKEEIATRLQRVLDRWKALKAQLIDERTKLGDYANLKQFYRDLEELEEWISEMLPTACDESYKDATNIQRKYLKHQTFAHEVDGRSEQVHGVINLGNSLIECSACDGNEEAMKEQLEQLKEHWDHLLERTNDKGKKLNEASRQQRFNTSIRDFEFWLSEAETLLAMKDQARDLASAGNLLKKHQLLEREMLAREDALKDLNTLAEDLLSSGTFNVDQIVKKKDNVNKRFLNVQELAAAHHEKLKEAYALFQFFQDLDDEESWIEEKLIRVSSQDYGRDLQGVQNLLKKHKRLEGELVAHEPAIQNVLDMAEKLKDKAAVGQEEIQLRLAQFVEHWEKLKELAKARGLKLEESLEYLQFMQNAEEEEAWINEKNALAVRGDCGDTLAATQSLLMKHEALENDFAVHETRVQNVCAQGEDILNKEESQNKEISSKIEALNEKTPSLAKAIAAWKLQLEDDYAFQEFNWKADVVEAWIADKETSLKTNGNGADLGDFLTLLAKQDTLDASLQSFQQERLPEITDLKDKLISAQHNQSKAIEERYAALLKRWEQLLEASAVHRQKLLEKQLPLQKAEDLFVEFAHKASALNNWCEKMEENLSEPVHCVSLNEIRQLQKDHEDFLASLARAQADFKCLLELDQQIKALGVPSSPYTWLTVEVLERTWKHLSDIIEEREQELQKEEARQVKNFEMCQEFEQNASTFLQWILETRAYFLDGSLLKETGTLESQLEANKRKQKEIQAMKRQLTKIVDLGDNLEDALILDIKYSTIGLAQQWDQLYQLGLRMQHNLEQQIQAKDIKGVSEETLKEFSTIYKHFDENLTGRLTHKEFRSCLRGLNYYLPMVEEDEHEPKFEKFLDAVDPGRKGYVSLEDYTAFLIDKESENIKSSDEIENAFQALAEGKSYITKEDMKQALTPEQVSFCATHMQQYMDPRGRSHLSGYDYVGFTNSYFGN

SEQ ID NO: 65094 - protein, 2419 aa, Homo sapiens
MEQFPKETVVESSGPKVLETAEEIQERRQEVLTRYQSFKERVAERGQKLEDSYHLQVFKRDADDLGKWIMEKVNILTDKSYEDPTNIQGKYQKHQSLEAEVQTKSRLMSELEKTREERFTMGHSAHEETKAHIEELRHLWDLLLELTLEKGDQLLRALKFQQYVQECADILEWIGDKEAIATSVELGEDWERTEVLHKKFEDFQVELVAKEGRVVEVNQYANECAEENHPDLPLIQSKQNEVNAAWERLRGLALQRQKALSNAANLQRFKRDVTEAIQWIKEKEPVLTSEDYGKDLVASEGLFHSHKGLERNLAVMSDKVKELCAKAEKLTLSHPSDAPQIQEMKEDLVSSWEHIRALATSRYEKLQATYWYHRFSSDFDELSGWMNEKTAAINADELPTDVAGGEVLLDRHQQHKHEIDSYDDRFQSADETGQDLVNANHEASDEVREKMEILDNNWTALLELWDERHRQYEQCLDFHLFYRDSEQVDSWMSRQEAFLENEDLGNSLGSAEALLQKHEDFEEAFTAQEEKIITVDKTATKLIGDDHYDSENIKAIRDGLLARRDALREKAATRRRLLKESLLLQKLYEDSDDLKNWINKKKKLADDEDYKDIQNLKSRVQKQQVFEKELAVNKTQLENIQKTGQEMIEGGHYASDNVTTRLSEVASLWEELLEATKQKGTQLHEANQQLQFENNAEDLQRWLEDVEWQVTSEDYGKGLAEVQNRLRKHGLLESAVAARQDQVDILTDLAAYFEEIGHPDSKDIRARQESLVCRFEALKEPLATRKKKLLDLLHLQLICRDTEDEEAWIQETEPSATSTYLGKDLIASKKLLNRHRVILENIASHEPRIQEITERGNKMVEEGHFAAEDVASRVKSLNQNMESLRARAARRQNDLEANVQFQQYLADLHEAETWIREKEPIVDNTNYGADEEAAGALLKKHEAFLLDLNSFGDSMKALRNQANACQQQQAAPVEGVAGEQRVMALYDFQARSPREVTMKKGDVLTLLSSINKDWWKVEAADHQGIVPAVYVRRLAHDEFPMLPQRRREEPGNITQRQEQIENQYRSLLDRAEERRRRLLQRYNEFLLAYEAGDMLEWIQEKKAENTGVELDDVWELQKKFDEFQKDLNTNEPRLRDINKVADDLLFEGLLTPEGAQIRQELNSRWGSLQRLADEQRQLLGSAHAVEVFHREADDTKEQIEKKCQALSAADPGSDLFSVQALQRRHEGFERDLVPLGDKVTILGETAERLSESHPDATEDLQRQKMELNEAWEDLQGRTKDRKESLNEAQKFYLFLSKARDLQNWISSIGGMVSSQELAEDLTGIEILLERHQEHRADMEAEAPTFQALEDFSAELIDSGHHASPEIEKKLQAVKLERDDLEKAWEKRKKILDQCLELQMFQGNCDQVESWMVARENSLRSDDKSSLDSLEALMKKRDDLDKAITAQEGKITDLEHFAESLIADEHYAKEEIATRLQRVLDRWKALKAQLIDERTKLGDYANLKQFYRDLEELEEWISEMLPTACDESYKDATNIQRKYLKHQTFAHEVDGRSEQVHGVINLGNSLIECSACDGNEEAMKEQLEQLKEHWDHLLERTNDKGKKLNEASRQQRFNTSIRDFEFWLSEAETLLAMKDQARDLASAGNLLKKHQLLEREMLAREDALKDLNTLAEDLLSSGTFNVDQIVKKKDNVNKRFLNVQELAAAHHEKLKEAYALFQFFQDLDDEESWIEEKLIRVSSQDYGRDLQGVQNLLKKHKRLEGELVAHEPAIQNVLDMAEKLKDKAAVGQEEIQLRLAQFVEHWEKLKELAKARGLKLEESLEYLQFMQNAEEEEAWINEKNALAVRGDCGDTLAATQSLLMKHEALENDFAVHETRVQNVCAQGEDILNKVLQEESQNKEISSKIEALNEKTPSLAKAIAAWKLQLEDDYAFQEFNWKADVVEAWIADKETSLKTNGNGADLGDFLTLLAKQDTLDASLQSFQQERLPEITDLKDKLISAQHNQSKAIEERYAALLKRWEQLLEASAVHRQKLLEKQLPLQKAEDLFVEFAHKASALNNWCEKMEENLSEPVHCVSLNEIRQLQKDHEDFLASLARAQADFKCLLELDQQIKALGVPSSPYTWLTVEVLERTWKHLSDIIEEREQELQKEEARQVKNFEMCQEFEQNASTFLQWILETRAYFLDGSLLKETGTLESQLEANKRKQKEIQAMKRQLTKIVDLGDNLEDALILDIKYSTIGLAQQWDQLYQLGLRMQHNLEQQIQAKDIKGVSEETLKEFSTIYKHFDENLTGRLTHKEFRSCLRGLNYYLPMVEEDEHEPKFEKFLDAVDPGRKGYVSLEDYTAFLIDKESENIKSSDEIENAFQALAEGKSYITKEDMKQALTPEQVSFCATHMQQYMDPRGRSHLSGYDYVGFTNSYFGN

SEQ ID NO: 65095 - protein, 2477 aa, Homo sapiens
MDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQVSLMLSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRCQPAGASCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 65096 - protein, 2452 aa, Homo sapiens
MDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRCQPAGASCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 65097 - protein, 494 aa, Homo sapiens
MAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRCQRKDGQLQGGRVGDPRIPA

SEQ ID NO: 65098 - protein, 2472 aa, Homo sapiens
MDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 65099 - protein, 2477 aa, Homo sapiens
MDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQLSKLLSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 65100 - protein, 1147 aa, Homo sapiens
MENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPGEEEGTWPQNLQQPPPPGQHKDGQKSTGDERPTTEPLFKVLDTPLSEGDEPATLPAPRDHGQSVQMEGYLGRKHDLEGPNKKASNSKGEEGEERRETEEEDEEEEETESVAVEMQQHASHVSWNNLYCVLRNSELTFYKDAKNLALGMPYHGEEPLALRHAICEIAANYKKKKHVFKLRLSNGSEWLFHGKDEEEMLSWLQGVSTAINESQSIRVKAQSLPLPSLSGPDASLGKKDKEKRFSFFPKKK

SEQ ID NO: 65101 - protein, 2106 aa, Homo sapiens
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAEYRRELALRNELIRQEKLEQLARRFDRKAAMRETWLSENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRISHLEQCFEELSNMAAGRKAQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWNALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTASRGGRRDSRGGSSFPPCGHRENVPGQSLVSFV

SEQ ID NO: 65102 - protein, 2137 aa, Homo sapiens
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAEYRRELALRNELIRQEKLEQLARRFDRKAAMRETWLSENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRISHLEQCFEELSNMAAGRKAQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWNALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPVSLWSRLSSSWESLQPEPSHPY

SEQ ID NO: 65103 - protein, 2328 aa, Homo sapiens
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAEYRRELALRNELIRQEKLEQLARRFDRKAAMRETWLSENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRISHLEQCFEELSNMAAGRKAQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWNALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPGEEEGTWPQNLQQPPPPGQHKDGQKSTGDERPTTEPLFKVLDTPLSEGDEPATLPAPRDHGQSVQMEGYLGRKHDLEGPNKKASNRSWNNLYCVLRNSELTFYKDAKNLALGMPYHGEEPLALRHAICEIAANYKKKKHVFKLRLSNGSEWLFHGKDEEEMLSWLQGVSTAINESQSIRVKAQSLPLPSLSGPDASLGKKDKEKRFSFFPKKK

SEQ ID NO: 65104 - protein, 2332 aa, Homo sapiens
EPADMTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAEYRRELALRNELIRQEKLEQLARRFDRKAAMRETWLSENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRISHLEQCFEELSNMAAGRKAQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWNALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPGEEEGTWPQNLQQPPPPGQHKDGQKSTGDERPTTEPLFKVLDTPLSEGDEPATLPAPRDHGQSVQMEGYLGRKHDLEGPNKKASNRSWNNLYCVLRNSELTFYKDAKNLALGMPYHGEEPLALRHAICEIAANYKKKKHVFKLRLSNGSEWLFHGKDEEEMLSWLQGVSTAINESQSIRVKAQSLPLPSLSGPDASLGKKDKEKRFSFFPKKK

SEQ ID NO: 65105 - protein, 2137 aa, Homo sapiens; identical to SEQ ID NO: 65102

SEQ ID NO: 65106 - protein, 2328 aa, Homo sapiens; identical to SEQ ID NO: 65103

SEQ ID NO: 65107 - protein, 2155 aa, Homo sapiens
MELQRTSSISGPLSPAYTGQVPYNYNQLEGRFKQLQDEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRVSYRSQTYQNYKNFNSRRTASDQPWSGL

SEQ ID NO: 65108 - protein, 2364 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 65109 - protein, 690 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGR

SEQ ID NO: 65110 - protein, 2390 aa, Homo sapiens
MSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLENVDKALQFLKEQKVHLENMGSHDIVDGNHRLTLGLVWTIILRFQIQDISVETEDNKEKKSAKDALLLWCQMKTAGYPNVNVHNFTTSWRDGLAFNAIVHKHRPDLLDFESLKKCNAHYNLQNAFNLAEKELGLTKLLDPEDVNVDQPDEKSIITYVATYYHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLEQSYEALCELAAARRARLEESRRLWRFLWEVGEAEAWVREQQHLLASADTGRDLTGALRLLNKHTALRGEMSGRLGPLKLTLEQGQQLVAEGHPGASQASARAAELQAQWERLEALAEERAQRLAQAASLYQFQADANDMEAWLVDALRLVSSPELGHDEFSTQALARQHRALEEEIRSHRPTLDALREQAAALPPTLSRTPEVQSRVPTLERHYEELQARAGERARALEAALALYTMLSEAGACGLWVEEKEQWLNGLALPERLEDLEVVQQRFETLEPEMNTLAAQITAVNDIAEQLLKANPPGKDRIVNTQEQLNHRWQQFRRLADGKKAALTSALSIQNYHLECTETQAWMREKTKVIESTQGLGNDLAGVLALQRKLAGTERDLEAIAARVGELTREANALAAGHPAQAVAINARLREVQTGWEDLRATMRRREESLGEARRLQDFLRSLDDFQAWLGRTQTAVASEEGPATLPEAEALLAQHAALRGEVERAQSEYSRLRALGEEVTRDQADPQCLFLRQRLEALGTGWEELGRMWESRQGRLAQAHGFQGFLRDARQAEGVLSSQEYVLSHTEMPGTLQAADAAIKKLEDFMSTMDANGERIHGLLEAGRQLVSEGNIHADKIREKADSIERRHKKNQDAAQQFLGRLRDNREQQHFLQDCHELKLWIDEKMLTAQDVSYDEARNLHTKWQKHQAFMAELAANKDWLDKVDKEGRELTLEKPELKALVSEKLRDLHRRWDELETTTQAKARSLFDANRAELFAQSCCALESWLESLQAQLHSDDYGKDLTSVNILLKKQQMLEWEMAVREKEVEAIQAQAKALAQEDQGAGEVERTSRAVEEKFRALCQPMRERCRRLQASREQHQFHRDVEDEILWVTERLPMASSMEHGKDLPSVQLLMKKNQTLQKEIQGHEPRIADLRERQRALGAAAAGPELAELQEMWKRLGHELELRGKRLEDALRAQQFYRDAAEAEAWMGEQELHMMGQEKAKDELSAQAEVKKHQVLEQALADYAQTIHQLAASSQDMIDHEHPESTRISIRQAQVDKLYAGLKELAGERRERLQEHLRLCQLRRELDDLEQWIQEREVVAASHELGQDYEHVTMLRDKFREFSRDTSTIGQERVDSANALANGLIAGGHAARATVAEWKDSLNEAWADLLELLDTRGQVLAAAYELQRFLHGARQALARVQHKQQQLPDGTGRDLNAAEALQRRHCAYEHDIQALSPQVQQVQDDGHRLQKAYAGDKAEEIGRHMQAVAEAWAQLQGSSAARRQLLLDTTDKFRFFKAVRELMLWMDEVNLQMDAQERPRDVSSADLVIKNQQGIKAEIEARADRFSSCIDMGKELLARSHYAAEEISEKLSQLQARRQETAEKWQEKMDWLQLVLEVLVFGRDAGMAEAWLCSQEPLVRSAELGCTVDEVESLIKRHEAFQKSAVAWEERFCALEKLTALEEREKERKRKREEEERRKQPPAPEPTASVPPGDLVGGQTASDTTWDGTQPRPPPSTQAPSVNGVCTDGEPSQPLLGQQRLEHSSFPEGPGPGSGDEANGPRGERQTRTRGPAPSAMPQSRSTESAHAATLPPRGPEPSAQEQMEGMLCRKQEMEAFGKKAANRSWQNVYCVLRRGSLGFYKDAKAASAGVPYHGEVPVSLARAQGSVAFDYRKRKHVFKLGLQDGKEYLFQAKDEAEMSSWLRVVNAAIATASSASGEPEEPVVPSTTRGMTRAMTMPPVSPVGAEGPVVLRSKDGREREREKRFSFFKKNK

SEQ ID NO: 65111 - protein, 934 aa, Homo sapiens
MSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLENVDKALQFLKEQKVHLENMGSHDIVDGNHRLTLGLVWTIILRFQIQDISVETEDNKEKKSAKDALLLWCQMKTAGYPNVNVHNFTTSWRDGLAFNAIVHKHRPDLLDFESLKKCNAHYNLQNAFNLAEKELGLTKLLDPEDVNVDQPDEKSIITYVATYYHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLTALEEREKERKRKREEEERRKQPPAPEPTASVPPGDLVGGQTASDTTWDGTQPRPPPSTQAPSVNGVCTDGEPSQPLLGQQRLEHSSFPEGPGPGSGDEANGPRGERQTRTRGPAPSAMPQSRSTESAHAATLPPRGPEPSAQEQMEGMLCRKQEMEAFGKKAANRSWQNVYCVLRRGSLGFYKDAKAASAGVPYHGEVPVSLARAQGSVAFDYRKRKHVFKLGLQDGKEYLFQAKDEAEMSSWLRVVNAAIATASSASGEPEEPVVPSTTRGMTRAMTMPPVSPVGAEGPVVLRSKDGREREREKRFSFFKKNK

SEQ ID NO: 65112 - protein, 117 aa, Homo sapiens
MSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLE

SEQ ID NO: 65113 - protein, 2365 aa, Homo sapiens
MSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLENVDKALQFLKEQKVHLENMGSHDIVDGNHRLTLGLVWTIILRFQIQDISVETEDNKEKKSAKDALLLWCQMKTAGYPNVNVHNFTTSWRDGLAFNAIVHKHRPDLLDFESLKKCNAHYNLQNAFNLAEKELGLTKLLDPEDVNVDQPDEKSIITYVATYYHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLEQSYEALCELAAARRARLEESRRLWRFLWEVGEAEAWVREQQHLLASADTGRDLTGALRLLNKHTALRGEMSGRLGPLKLTLEQGQQLVAEGHPGASQASARAAELQAQWERLEALAEERAQRLAQAASLYQFQADANDMEAWLVDALRLVSSPELGHDEFSTQALARQHRALEEEIRSHRPTLDALREQAAALPPTLSRTPEVQSRVPTLERHYEELQARAGERARALEAALALYTMLSEAGACGLWVEEKEQWLNGLALPERLEDLEVVQQRFETLEPEMNTLAAQITAVNDIAEQLLKANPPGKDRIVNTQEQLNHRWQQFRRLADGKKAALTSALSIQNYHLECTETQAWMREKTKVIESTQGLGNDLAGVLALQRKLAGTERDLEAIAARVGELTREANALAAGHPAQAVAINARLREVQTGWEDLRATMRRREESLGEARRLQDFLRSLDDFQAWLGRTQTAVASEEGPATLPEAEALLAQHAALRGEVERAQSEYSRLRALGEEVTRDQADPQCLFLRQRLEALGTGWEELGRMWESRQGRLAQAHGFQGFLRDARQAEGVLSSQEYVLSHTEMPGTLQAADAAIKKLEDFMSTMDANGERIHGLLEAGRQLVSEGNIHADKIREKADSIERRHKKNQDAAQQFLGRLRDNREQQHFLQDCHELKLWIDEKMLTAQDVSYDEARNLHTKWQKHQAFMAELAANKDWLDKVDKEGRELTLEKPELKALVSEKLRDLHRRWDELETTTQAKARSLFDANRAELFAQSCCALESWLESLQAQLHSDDYGKDLTSVNILLKKQQMLEWEMAVREKEVEAIQAQAKALAQEDQGAGEVERTSRAVEEKFRALCQPMRERCRRLQASREQHQFHRDVEDEILWVTERLPMASSMEHGKDLPSVQLLMKKNQTLQKEIQGHEPRIADLRERQRALGAAAAGPELAELQEMWKRLGHELELRGKRLEDALRAQQFYRDAAEAEAWMGEQELHMMGQEKAKDELSAQAEVKKHQVLEQALADYAQTIHQLAASSQDMIDHEHPESTRISIRQAQVDKLYAGLKELAGERRERLQEHLRLCQLRRELDDLEQWIQEREVVAASHELGQDYEHVTMLRDKFREFSRDTSTIGQERVDSANALANGLIAGGHAARATVAEWKDSLNEAWADLLELLDTRGQVLAAAYELQRFLHGARQALARVQHKQQQLPDGTGRDLNAAEALQRRHCAYEHDIQALSPQVQQVQDDGHRLQKAYAGDKAEEIGRHMQAVAEAWAQLQGSSAARRQLLLDTTDKFRFFKAVRELMLWMDEVNLQMDAQERPRDVSSADLVIKNQQGIKAEIEARADRFSSCIDMGKELLARSHYAAEEISEKLSQLQARRQETAEKWQEKMDWLQLVLEVLVFGRDAGMAEAWLCSQEPLVRSAELGCTVDEVESLIKRHEAFQKSAVAWEERFCALEKLTALEEREKERKRKREEEERRKQPPAPEPTASVPPGDLVGGQTASDTTWDGTQPRPPPSTQAPSVNGVCTDGEPSQPLLGQQRLEHSSFPEGPGPGSGDEANGPRGERQTRTRGPAPSAMPQSRSTESAHAATLPPRGPEPSAQEQMEGMLCRKQEMEAFGKKAANRSWQNVYCVLRRGSLGFYKDAKAASAGVPYHGEVPVSLARAQGSVAFDYRKRKHVFKLGLQDGKEYLFQAKDEVSCPSCSSLSVPFQKLPAADSPSFPVLPLFPGLVLCGKTGCVRRPHQAALPV

SEQ ID NO: 65114 - protein, 2390 aa, Homo sapiens; identical to SEQ ID NO: 65110

SEQ ID NO: 65115 - protein, 2154 aa, Homo sapiens
MAQVPGEVDNMEGLPAPNNNPAARWESPDRGWEREQPAASTAAASLFECSRIKALADEREAVQKKTFTKWVNSHLARVGCHIGDLYVDLRDGFVLTRLLEVLSGEQLPRPTRGRMRIHSLENVDKALQFLKEQRVHLENVGSHDIVDGNHRLTLGLVWTIILRFQIQVIKIETEDNRETRSAKDALLLWCQMKTAGYPEVNIQNFTTSWRDGLAFNALIHRHRPDLVDFSKLTKSNANYNLQRAFRTAEQHLGLARLLDPEDVNMEAPDEKSIITYVVSFYHYFSKMKALAVEGKRIGKVLDQVLEVGKIIERYEELAAELLAWIHRTVGLISNQKFANSLSGVQQQLQAFTAYCTLEKPVKFQEKGNLEVLLFSIQSKLRACNRRLFVPREGCGIWDIDKAWGELEKAEHEREAALRAELIRQEKLELLAQRFDHKVAMRESWLNENQRLVSQDNFGYELPAVEAAMKKHEAIEADIAAYEERVQGVAELAQALAAEGYYDIRRVAAQRDSVLRQWALLTGLVGARRTRLEQNLALQKVFQEMVYMVDWMEEMQAQLLSRECGQHLVEADDLLQKHGLLEGDIAAQSERVEALNAAALRFSQLQGYQPCDPQVICNRVNHVHGCLAELQEQAARRRAELEASRSLWALLQELEEAESWARDKERLLEAAGGGGAAGAAGAAGTAGGAHDLSSTARLLAQHKILQGELGGRRALLQQALRCGEELVAAGGAVGPGADTVHLVGLAERAASARRRWQRLEEAAARRERRLQEARALHQFGADLDGLLDWLRDAYRLAAAGDFGHDEASSRRLARQHRALTGEVEAHRGPVSGLRRQLATLGGASGAGPLVVALQVRVVEAEQLFAEVTEVAALRRQWLRDALAVYRMFGEVHACELWIGEKEQWLLSMRVPDSLDDVEVVQHRFESLDQEMNSLMGRVLDVNHTVQELVEGGHPSSDEVRSCQDHLNSRWNRIVELVEQRKEEMSAVLLVENHVLEVAEVRAQVREKRRAVESAPRAGGALQWRLSGLEAALQALEPRQAALLEEAALLAERFPAQAARLHQGAEELGAEWGALASAAQACGEAVAAAGRLQRFLHDLDAFLDWLVRAQEAAGGSEGPLPNSLEEADALLARHAALKEEVDQREEDYARIVAASEALLAADGAELGPGLALDEWLPHLELGWHKLLGLWEARREALVQAHIYQLFLRDLRQALVVLRNQEMALSGAELPGTVESVEEALKQHRDFLTTMELSQQKMQVAVQAAEGLLRQGNIYGEQAQEAVTRLLEKNQENQLRAQQWMQKLHDQLELQHFLRDCHELDGWIHEKMLMARDGTREDNHKLHKRWLRHQAFMAELAQNKEWLEKIEREGQQLMQEKPELAASVRKKLGEIRQCWAELESTTQAKARQLFEASKADQLVQSFAELDKKLLHMESQLQDVDPGGDLATVNSQLKKLQSMESQVEEWYREVGELQAQTAALPLEPASKELVGERQNAVGERLVRLLEPLQERRRLLLASKELHQVAHDLDDELAWVQERLPLAMQTERGNGLQAVQQHIKKNQGLRREIQAHGPRLEEVLERAGALASLRSPEAEAVRRGLEQLQSAWAGLREAAERRQQVLDAAFQVEQYYFDVAEVEAWLGEQELLMMSEDKGKDEQSTLQLLKKHLQLEQGVENYEESIAQLSRQCRALLEMGHPDSEQISRRQSQVDRLYVALKELGEERRVALEQQYWLYQLSRQVSELEHWIAEKEVVAGSPELGQDFEHVSVLQEKFSEFASETGMAGRERLAAVNQMVDELIECGHTAAATMAEWKDGLNEAWAELLELMGTRAQLLAASRELHKFFSDARELQGQIEEKRRRLPRLTTPPEPRPSASSMQRTLRAFEHDLQLLVSQVRQLQEGAAQLRTVYAGEHAEAIASREQEVLQGWKELLSACEDARLHVSSTADALRFHSQVRDLLSWMDGIASQIGAADKPRDVSSVEVLMNYHQGLKTELEARVPELTTCQELGRSLLLNKSAMADEIQAQLDKLGTRKEEVSEKWDRHWEWLQQMLEVHQFAQEAVVADAWLTAQEPLLQSRELGSSVDEVEQLIRRHEAFRKAAAAWEERFSSLRRLTTPRREDHLNPGVQDQPWQHTEKPSLPKPKANKEKTARRDGTCL

SEQ ID NO: 65116 - protein, 1309 aa, Homo sapiens
MAQVPGEVDNMEGLPAPNNNPAARWESPDRGWEREQPAASTAAASLFECSRIKALADEREAVQKKTFTKWVNSHLARVGCHIGDLYVDLRDGFVLTRLLEVLSGEQLPRPTRGRMRIHSLENVDKALQFLKEQRVHLENVGSHDIVDGNHRLTLGLVWTIILRFQIQVIKIETEDNRETRSAKDALLLWCQMKTAGYPEVNIQNFTTSWRDGLAFNALIHRHRPDLVDFSKLTKSNANYNLQRAFRTAEQHLGLARLLDPEDVNMEAPDEKSIITYVVSFYHYFSKMKALAVEGKRIGKVLDQVLEVGKIIERYEELAAELLAWIHRTVGLISNQKFANSLSGVQQQLQAFTAYCTLEKPVKFQEKGNLEVLLFSIQSKLRACNRRLFVPREGCGIWDIDKAWGELEKAEHEREAALRAELIRQEKLELLAQRFDHKVAMRESWLNENQRLVSQDNFGYELPAVEAAMKKHEAIEADIAAYEERVQGVAELAQALAAEGYYDIRRVAAQRDSVLRQWALLTGLVGARRTRLEQNLALQKVFQEMVYMVDWMEEMQAQLLSRECGQHLVEADDLLQKHGLLEGDIAAQSERVEALNAAALRFSQLQGYQPCDPQVICNRVNHVHGCLAELQEQAARRRAELEASRSLWALLQELEEAESWARDKERLLEAAGGGGAAGAAGAAGTAGGAHDLSSTARLLAQHKILQGELGGRRALLQQALRCGEELVAAGGAVGPGADTVHLVGLAERAASARRRWQRLEEAAARRERRLQEARALHQFGADLDGLLDWLRDAYRLAAAGDFGHDEASSRRLARQHRALTGEVEAHRGPVSGLRRQLATLGGASGAGPLVVALQVRVVEAEQLFAEVTEVAALRRQWLRDALAVYRMFGEVHACELWIGEKEQWLLSMRVPDSLDDVEVVQHRFESLDQEMNSLMGRVLDVNHTVQELVEGGHPSSDEVRSCQDHLNSRWNRIVELVEQRKEEMSAVLLVENHVLEVAEVRAQVREKRRAVESAPRAGGALQWRLSGLEAALQALEPRQAALLEEAALLAERFPAQAARLHQGAEELGAEWGALASAAQACGEAVAAAGRLQRFLHDLDAFLDWLVRAQEAAGGSEGPLPNSLEEADALLARHAALKEEVDQREEDYARIVAASEALLAADGAELGPGLALDEWLPHLELGWHKLLGLWEARREALVQAHIYQLFLRDLRQALVVLRNQEMALSGAELPGTVESVEEALKQHRDFLTTMELSQQKMQVAVQAAEGLLRQGNIYGEQAQEAVTRLLEKCLIIHPALLHPPWEPPDLPRSSS

SEQ ID NO: 65117 - protein, 2564 aa, Homo sapiens
MAQVPGEVDNMEGLPAPNNNPAARWESPDRGWEREQPAASTAAASLFECSRIKALADEREAVQKKTFTKWVNSHLARVGCHIGDLYVDLRDGFVLTRLLEVLSGEQLPRPTRGRMRIHSLENVDKALQFLKEQRVHLENVGSHDIVDGNHRLTLGLVWTIILRFQIQVIKIETEDNRETRSAKDALLLWCQMKTAGYPEVNIQNFTTSWRDGLAFNALIHRHRPDLVDFSKLTKSNANYNLQRAFRTAEQHLGLARLLDPEDVNMEAPDEKSIITYVVSFYHYFSKMKALAVEGKRIGKVLDQVLEVGKIIERYEELAAELLAWIHRTVGLISNQKFANSLSGVQQQLQAFTAYCTLEKPVKFQEKGNLEVLLFSIQSKLRACNRRLFVPREGCGIWDIDKAWGELEKAEHEREAALRAELIRQEKLELLAQRFDHKVAMRESWLNENQRLVSQDNFGYELPAVEAAMKKHEAIEADIAAYEERVQGVAELAQALAAEGYYDIRRVAAQRDSVLRQWALLTGLVGARRTRLEQNLALQKVFQEMVYMVDWMEEMQAQLLSRECGQHLVEADDLLQKHGLLEGDIAAQSERVEALNAAALRFSQLQGYQPCDPQVICNRVNHVHGCLAELQEQAARRRAELEASRSLWALLQELEEAESWARDKERLLEAAGGGGAAGAAGAAGTAGGAHDLSSTARLLAQHKILQGELGGRRALLQQALRCGEELVAAGGAVGPGADTVHLVGLAERAASARRRWQRLEEAAARRERRLQEARALHQFGADLDGLLDWLRDAYRLAAAGDFGHDEASSRRLARQHRALTGEVEAHRGPVSGLRRQLATLGGASGAGPLVVALQVRVVEAEQLFAEVTEVAALRRQWLRDALAVYRMFGEVHACELWIGEKEQWLLSMRVPDSLDDVEVVQHRFESLDQEMNSLMGRVLDVNHTVQELVEGGHPSSDEVRSCQDHLNSRWNRIVELVEQRKEEMSAVLLVENHVLEVAEVRAQVREKRRAVESAPRAGGALQWRLSGLEAALQALEPRQAALLEEAALLAERFPAQAARLHQGAEELGAEWGALASAAQACGEAVAAAGRLQRFLHDLDAFLDWLVRAQEAAGGSEGPLPNSLEEADALLARHAALKEEVDQREEDYARIVAASEALLAADGAELGPGLALDEWLPHLELGWHKLLGLWEARREALVQAHIYQLFLRDLRQALVVLRNQEMALSGAELPGTVESVEEALKQHRDFLTTMELSQQKMQVAVQAAEGLLRQGNIYGEQAQEAVTRLLEKNQENQLRAQQWMQKLHDQLELQHFLRDCHELDGWIHEKMLMARDGTREDNHKLHKRWLRHQAFMAELAQNKEWLEKIEREGQQLMQEKPELAASVRKKLGEIRQCWAELESTTQAKARQLFEASKADQLVQSFAELDKKLLHMESQLQDVDPGGDLATVNSQLKKLQSMESQVEEWYREVGELQAQTAALPLEPASKELVGERQNAVGERLVRLLEPLQERRRLLLASKELHQVAHDLDDELAWVQERLPLAMQTERGNGLQAVQQHIKKNQGLRREIQAHGPRLEEVLERAGALASLRSPEAEAVRRGLEQLQSAWAGLREAAERRQQVLDAAFQVEQYYFDVAEVEAWLGEQELLMMSEDKGKDEQSTLQLLKKHLQLEQGVENYEESIAQLSRQCRALLEMGHPDSEQISRRQSQVDRLYVALKELGEERRVALEQQYWLYQLSRQVSELEHWIAEKEVVAGSPELGQDFEHVSVLQEKFSEFASETGMAGRERLAAVNQMVDELIECGHTAAATMAEWKDGLNEAWAELLELMGTRAQLLAASRELHKFFSDARELQGQIEEKRRRLPRLTTPPEPRPSASSMQRTLRAFEHDLQLLVSQVRQLQEGAAQLRTVYAGEHAEAIASREQEVLQGWKELLSACEDARLHVSSTADALRFHSQVRDLLSWMDGIASQIGAADKPRDVSSVEVLMNYHQGLKTELEARVPELTTCQELGRSLLLNKSAMADEIQAQLDKLGTRKEEVSEKWDRHWEWLQQMLEVHQFAQEAVVADAWLTAQEPLLQSRELGSSVDEVEQLIRRHEAFRKAAAAWEERFSSLRRLTTIEKIKAEQSKQPPTPLLGRKFFGDPTELAAKAAPLLRPGGYERGLEPLARRASDTLSAEVRTRVGYVRQELKPERLQPRIDRLPEIPGRVEPAALPAAPEDAAETPATPAAAEQVRPRPERQESADRAEELPRRRRPERQESVDQSEEAARRRRPERQESAEHEAAHSLTLGRYEQMERRRERRERRLERQESSEQEMPIRGDLVKGKATLADIVEQLQEKEAGPGLPAGPSLPQPRELPPGRLPNGLELPERTPRPDRPRARDRPKPRRRPRPREGGEGGGSRRSRSAPAQGGSAPAPPPPPTHTVQHEGFLLRKRELDANRKSSNRSWVSLYCVLSKGELGFYKDSKGPASGSTHGGEPLLSLHKATSEVASDYKKKKHVFKLQTQDGSEFLLQAKDEEEMNGWLEAVASSVAEHAEIARWGQTLPTTSSTDEGNPKREGGDRRASGRRK

SEQ ID NO: 65118 - protein, 678 aa, Homo sapiens
MLMARDGTREDNHKLHKRWLRHQAFMAELAQNKEWLEKIEREGQQLMQEKPELAASVRKKLGEIRQCWAELESTTQAKARQLFEASKADQLVQSFAELDKKLLHMESQLQDVDPGGDLATVNSQLKKLQSMESQVEEWYREVGELQAQTAALPLEPASKELVGERQNAVGERLVRLLEPLQERRRLLLASKELHQVAHDLDDELAWVQERLPLAMQTERGNGLQAVQQHIKKNQGLRREIQAHGPRLEEVLERAGALASLRSPEAEAVRRGLEQLQSAWAGLREAAERRQQVLDAAFQVEQYYFDVAEVEAWLGEQELLMMSEDKGKDEQSTLQLLKKHLQLEQGVENYEESIAQLSRQCRALLEMGHPDSEQISRRQSQVDRLYVALKELGEERRVALEQQYWLYQLSRQVSELEHWIAEKEVVAGSPELGQDFEHVSVLQEKFSEFASETGMAGRERLAAVNQMVDELIECGHTAAATMAEWKDGLNEAWAELLELMGTRAQLLAASRELHKFFSDARELQGQIEEKRRRLPRLTTPPEPRPSASSMQRTLRAFEHDLQLLVSQVRQLQEGAAQLRTVYAGEHAEAIASREQEVLQGWKELLSACEDARLHVSSTADALRFHSQVRDLLSWMDGIASQIGAADKPRCPSSLLGLPASPWWPTPATPSPLTAPFSME

SEQ ID NO: 65119 - protein, 1307 aa, Homo sapiens
MPHYPSCSSAPSLGTPRPPQIQQLEARHRNQENQLRAQQWMQKLHDQLELQHFLRDCHELDGWIHEKMLMARDGTREDNHKLHKRWLRHQAFMAELAQNKEWLEKIEREGQQLMQEKPELAASVRKKLGEIRQCWAELESTTQAKARQLFEASKADQLVQSFAELDKKLLHMESQLQDVDPGGDLATVNSQLKKLQSMESQVEEWYREVGELQAQTAALPLEPASKELVGERQNAVGERLVRLLEPLQERRRLLLASKELHQVAHDLDDELAWVQERLPLAMQTERGNGLQAVQQHIKKNQGLRREIQAHGPRLEEVLERAGALASLRSPEAEAVRRGLEQLQSAWAGLREAAERRQQVLDAAFQVEQYYFDVAEVEAWLGEQELLMMSEDKGKDEQSTLQLLKKHLQLEQGVENYEESIAQLSRQCRALLEMGHPDSEQISRRQSQVDRLYVALKELGEERRVALEQQYWLYQLSRQVSELEHWIAEKEVVAGSPELGQDFEHVSVLQEKFSEFASETGMAGRERLAAVNQMVDELIECGHTAAATMAEWKDGLNEAWAELLELMGTRAQLLAASRELHKFFSDARELQGQIEEKRRRLPRLTTPPEPRPSASSMQRTLRAFEHDLQLLVSQVRQLQEGAAQLRTVYAGEHAEAIASREQEVLQGWKELLSACEDARLHVSSTADALRFHSQVRDLLSWMDGIASQIGAADKPRDVSSVEVLMNYHQGLKTELEARVPELTTCQELGRSLLLNKSAMADEIQAQLDKLGTRKEEVSEKWDRHWEWLQQMLEVHQFAQEAVVADAWLTAQEPLLQSRELGSSVDEVEQLIRRHEAFRKAAAAWEERFSSLRRLTTIEKIKAEQSKQPPTPLLGRKFFGDPTELAAKAAPLLRPGGYERGLEPLARRASDTLSAEVRTRVGYVRQELKPERLQPRIDRLPEIPGRVEPAALPAAPEDAAETPATPAAAEQVRPRPERQESADRAEELPRRRRPERQESVDQSEEAARRRRPERQESAEHEAAHSLTLGRYEQMERRRERRERRLERQESSEQEMPIRGDLVKGKATLADIVEQLQEKEAGPGLPAGPSLPQPRELPPGRLPNGLELPERTPRPDRPRARDRPKPRRRPRPREGGEGGGSRRSRSAPAQGGSAPAPPPPPTHTVQHEGFLLRKRELDANRKSSNRSWVSLYCVLSKGELGFYKDSKGPASGSTHGGEPLLSLHKATSEVASDYKKKKHVFKLQTQDGSEFLLQAKDEEEMNGWLEAVASSVAEHAEIARWGQTLPTTSSTDEGNPKREGGDRRASGRRK

SEQ ID NO: 65120 - protein, 2564 aa, Homo sapiens
MAQVPGEVDNMEGLPAPNNNPAARWESPDRGWEREQPAASTAAASLFECSRIKALADEREAVQKKTFTKWVNSHLARVGCHIGDLYVDLRDGFVLTRLLEVLSGEQLPRPTRGRMRIHSLENVDKALQFLKEQRVHLENVGSHDIVDGNHRLTLGLVWTIILRFQIQVIKIETEDNRETRSAKDALLLWCQMKTAGYPEVNIQNFTTSWRDGLAFNALIHRHRPDLVDFSKLTKSNANYNLQRAFRTAEQHLGLARLLDPEDVNMEAPDEKSIITYVVSFYHYFSKMKALAVEGKRIGKVLDQVLEVGKIIERYEELAAELLAWIHRTVGLISNQKFANSLSGVQQQLQAFTAYCTLEKPVKFQEKGNLEVLLFSIQSKLRACNRRLFVPREGCGIWDIDKAWGELEKAEHEREAALRAELIRQEKLELLAQRFDHKVAMRESWLNENQRLVSQDNFGYELPAVEAAMKKHEAIEADIAAYEERVQGVAELAQALAAEGYYDIRRVAAQRDSVLRQWALLTGLVGARRTRLEQNLALQKVFQEMVYMVDWMEEMQAQLLSRECGQHLVEADDLLQKHGLLEGDIAAQSERVEALNAAALRFSQLQGYQPCDPQVICNRVNHVHGCLAELQEQAARRRAELEASRSLWALLQELEEAESWARDKERLLEAAGGGGAAGAAGAAGTAGGAHDLSSTARLLAQHKILQGELGGRRALLQQALRCGEELVAAGGAVGPGADTVHLVGLAERAASARRRWQRLEEAAARRERRLQEARALHQFGADLDGLLDWLRDAYRLAAAGDFGHDEASSRRLARQHRALTGEVEAHRGPVSGLRRQLATLGGASGAGPLVVALQVRVVEAEQLFAEVTEVAALRRQWLRDALAVYRMFGEVHACELWIGEKEQWLLSMRVPDSLDDVEVVQHRFESLDQEMNSLMGRVLDVNHTVQELVEGGHPSSDEVRSCQDHLNSRWNRIVELVEQRKEEMSAVLLVENHVLEVAEVRAQVREKRRAVESAPRAGGALQWRLSGLEAALQALEPRQAALLEEAALLAERFPAQAARLHQGAEELGAEWGALASAAQACGEAVAAAGRLQRFLHDLDAFLDWLVRAQEAAGGSEGPLPNSLEEADALLARHAALKEEVDQREEDYARIVAASEALLAADGAELGPGLALDEWLPHLELGWHKLLGLWEARREALVQAHIYQLFLRDLRQALVVLRNQEMALSGAELPGTVESVEEALKQHRDFLTTMELSQQKMQVAVQAAEGLLRQGNIYGEQAQEAVTRLLEKNQENQLRAQQWMQKLHDQLELQHFLRDCHELDGWIHEKMLMARDGTREDNHKLHKRWLRHQAFMAELAQNKEWLEKIEREGQQLMQEKPELAASVRKKLGEIRQCWAELESTTQAKARQLFEASKADQLVQSFAELDKKLLHMESQLQDVDPGGDLATVNSQLKKLQSMESQVEEWYREVGELQAQTAALPLEPASKELVGERQNAVGERLVRLLEPLQERRRLLLASKELHQVAHDWTTSWAWVQERLPLAMQTERGNGLQAVQQHIKKNQGLRREIQAHGPRLEEVLERAGALASLRSPEAEAVRRGLEQLQSAWAGLREAAERRQQVLDAAFQVEQYYFDVAEVEAWLGEQELLMMSEDKGKDEQSTLQLLKKHLQLEQGVENYEESIAQLSRQCRALLEMGHPDSEQISRRQSQVDRLYVALKELGEERRVALEQQYWLYQLSRQVSELEHWIAEKEVVAGSPELGQDFEHVSVLQEKFSEFASETGMAGRERLAAVNQMVDELIECGHTAAATMAEWKDGLNEAWAELLELMGTRAQLLAASRELHKFFSDARELQGQIEEKRRRLPRLTTPPEPRPSASSMQRTLRAFEHDLQLLVSQVRQLQEGAAQLRTVYAGEHAEAIASREQEVLQGWKELLSACEDARLHVSSTADALRFHSQVRDLLSWMDGIASQIGAADKPRDVSSVEVLMNYHQGLKTELEARVPELTTCQELGRSLLLNKSAMADEIQAQLDKLGTRKEEVSEKWDRHWEWLQQMLEVHQFAQEAVVADAWLTAQEPLLQSRELGSSVDEVEQLIRRHEAFRKAAAAWEERFSSLRRLTTIEKIKAEQSKQPPTPLLGRKFFGDPTELAAKAAPLLRPGGYERGLEPLARRASDTLSAEVRTRVGYVRQELKPERLQPRIDRLPEIPGRVEPAALPAAPEDAAETPATPAAAEQVRPRPERQESADRAEELPRRRRPERQESVDQSEEAARRRRPERQESAEHEAAHSLTLGRYEQMERRRERRERRLERQESSEQEMPIRGDLVKGKATLADIVEQLQEKEAGPGLPAGPSLPQPRELPPGRLPNGLELPERTPRPDRPRARDRPKPRRRPRPREGGEGGGSRRSRSAPAQGGSAPAPPPPPTHTVQHEGFLLRKRELDANRKSSNRSWVSLYCVLSKGELGFYKDSKGPASGSTHGGEPLLSLHKATSEVASDYKKKKHVFKLQTQDGSEFLLQAKDEEEMNGWLEAVASSVAEHAEIARWGQTLPTTSSTDEGNPKREGGDRRASGRRK

SEQ ID NO: 65121 - protein, 3674 aa, Homo sapiens
MAGQPHSPRELLGAAGHRSRRPSTELRVPPSPSLTMDSQYETGHIRKLQARHMQMQEKTFTKWINNVFQCGQAGIKIRNLYTELADGIHLLRLLELISGEALPPPSRGRLRVHFLENSSRALAFLRAKVPVPLIGPENIVDGDQTLILGLIWVIILRFQISHISLDKEEFGASAALLSTKEALLVWCQRKTASYTNVNITDFSRSWSDGLGFNALIHAHRPDLLDYGSLRPDRPLHNLAFAFLVAEQELGIAQLLDPEDVAAAQPDERSIMTYVSLYYHYCSRLHQGQTVQRRLTKILLQLQETELLQTQYEQLVADLLRWIAEKQMQLEARDFPDSLPAMRQLLAAFTIFRTQEKPPRLQQRGAAEALLFRLQTALQAQNRRPFLPHEGLGLAELSQCWAGLEWAEAARSQALQQRLLQLQRLETLARRFQHKAALRESFLKDAEQVLDQARAPPASLATVEAAVQRLGMLEAGILPQEGRFQALAEIADILRQEQYHSWADVARRQEEVTVRWQRLLQHLQGQRKQVADMQAVLSLLQEVEAASHQLEELQEPARSTACGQQLAEVVELLQRHDLLEAQVSAHGAHVSHLAQQTAELDSSLGTSVEVLQAKARTLAQLQQSLVALVRARRALLEQTLQRAEFLRNCEEEEAWLKECGQRVGNAALGRDLSQIAGALQKHKALEAEVHRHQAVCVDLVRRGRDLSARRPPTQPDPGERAEAVQGGWQLLQTRVVGRGARLQTALLVLQYFADAAEAASWLRERRSSLERASCGQDQAAAETLLRRHVRLERVLRAFAAELRRLEEQGRAASARASLFTVNSALSPPGESLRNPGPWSEASCHPGPGDAWKMALPAEPDPDFDPNTILQTQDHLSQDYESLRALAQLRRARLEEAMALFGFCSSCGELQLWLEKQTVLLQRVQPQADTLEVMQLKYENFLTALAVGKGLWAEVSSSAEQLRQRYPGNSTQIQRQQEELSQRWGQLEALKREKAVQLAHSVEVCSFLQECGPTQVQLRDVLLQLEALQPGSSEDTCHALQLAQKKTLVLERRVHFLQSVVVKVEEPGYAESQPLQGQVETLQGLLKQVQEQVAQRARRQAETQARQSFLQESQQLLLWAESVQAQLRSKEVSVDVASAQRLLREHQDLLEEIHLWQERLQQLDAQSQPMAALDCPDSQEVPNTLRVLGQQGQELKVLWEQRQQWLQEGLELQKFGREVDGFTATCANHQAWLHLDNLGEDVREALSLLQQHREFGRLLSTLGPRAEALRAHGEKLVQSQHPAAHTVREQLQSIQAQWTRLQGRSEQRRRQLLASLQLQEWKQDVAELMQWMEEKGLMAAHEPSGARRNILQTLKRHEAAESELLATRRHVEALQQVGRELLSRRPCGQEDIQTRLQGLRSKWEALNRKMTERGDELQQAGQQEQLLRQLQDAKEQLEQLEGALQSSETGQDLRSSQRLQKRHQQLESESRTLAAKMAALASMAHGMAASPAILEETQKHLRRLELLQGHLAIRGLQLQASVELHQFCHLSNMELSWVAEHMPHGSPTSYTECLNGAQSLHRKHKELQVEVKAHQGQVQRVLSSGRSLAASGHPQAQHIVEQCQELEGHWAELERACEARAQCLQQAVTFQQYFLDVSELEGWVEEKRPLVSSRDYGRDEAATLRLINKHQALQEELAIYWSSMEELDQTAQTLTGPEVPEQQRVVQERLREQLRALQELAATRDRELEGTLRLHEFLREAEDLQGWLASQKQAAKGGESLGEDPEHALHLCTKFAKFQHQVEMGSQRVAACRLLAESLLERGHSAGPMVRQRQQDLQTAWSELWELTQARGHALRDTETTLRVHRDLLEVLTQVQEKATSLPNNVARDLCGLEAQLRSHQGLERELVGTERQLQELLETAGRVQKLCPGPQAHAVQQRQQAVTQAWAVLQRRMEQRRAQLERARLLARFRTAVRDYASWAARVRQDLQVEESSQEPSSGPLKLSAHQWLRAELEAREKLWQQATQLGQQALLAAGTPTKEVQEELRALQDQRDQVYQTWARKQERLQAEQQEQLFLRECGRLEEILAAQEVSLKTSALGSSVEEVEQLIRKHEVFLKVLTAQDKKEAALRERLKTLRRPRVRDRLPILLQRRMRVKELAESRGHALHASLLMASFTQAATQAEDWIQAWAQQLKEPVPPGDLRDKLKPLLKHQAFEAEVQAHEEVMTSVAKKGEALLAQSHPRAGEVSQRLQGLRKHWEDLRQAMALRGQELEDRRNFLEFLQRVDLAEAWIQEKEVKMNVGDLGQDLEHCLQLRRRLREFRGNSAGDTVGDACIRSISDLSLQLKNRDPEEVKIICQRRSQLNNRWASFHGNLLRYQQQLEGALEIHVLSRELDNVTKRIQEKEALIQALDCGKDLESVQRLLRKHEELEREVHPIQAQVESLEREVGRLCQRSPEAAHGLRHRQQEVAESWWQLRSRAQKRREALDALHQAQKLQAMLQELLVSAQRLRAQMDTSPAPRSPVEARRMLEEHQECKAELDSWTDSISLARSTGQQLLTAGHPFSSDIRQVLAGLEQELSSLEGAWQEHQLQLQQALELQLFLSSVEKMERWLCSKEDSLASEGLWDPLAPMEPLLWKHKMLEWDLEVQAGKISALEATARGLHQGGHPEAQSALGRCQAMLLRKEALFRQAGTRRHRLEELRQLQAFLQDSQEVAAWLREKNLVALEEGLLDTAMLPAQLQKQQNFQAELDASMHQQQELQREGQRLLQGGHPASEAIQERLEELGALWGELQDNSQKKVAKLQKACEALRLRRSMEELENWLEPIEVELRAPTVGQALPGVGELLGTQRELEAAVDKKARQAEALLGQAQAFVREGHCLAQDVEEQARRLLQRFKSLREPLQERRTALEARSLLLKFFRDADEEMAWVQEKLPLAAAQDYGQSLSAVRHLQEQHQNLESEMSSHEALTRVVLGTGYKLVQAGHFAAHEVAARVQQLEKAMAHLRAEAARRRLLLQQAQEAQQFLTELLEAGSWLAERGHVLDSEDMGHSAEATQALLRRLEATKRDLEAFSPRIERLQQTAALLESRKNPESPKVLAQLQAVREAHAELLRRAEARGHGLQEQLQLHQLERETLLLDAWLTTKAATAESQDYGQDLEGVKVLEEKFDAFRKEVQSLGQAKVYALRKLAGTLERGAPRRYPHIQAQRSRIEAAWERLDQAIKARTENLAAAHEVHSFQQAAAELQGRMQEKTALMKGEDGGHSLSSVRTLQQQHRRLERELEAMEKEVARLQTEACRLGQLHPAAPGGLAKVQEAWATLQAKAQERGQWLAQAAQGHAFLGRCQELLAWAQERQELASSEELAEDVAGAEQLLGQHEELGQEIRECRLQAQDLRQEGQQLVDNSHFMSAEVTECLQELEGRLQELEEAWALRWQRCAESWGLQKLRQRLEQAEAWLACWEGLLLKPDYGHSVSDVELLLHRHQDLEKLLAAQEEKFAQMQKTEMEQELLLQPQELKPGRAGSSLTSFQWRPSGHQGLGAQLAETRDPQDAKGTPTMEGSLEFKQHLLPGGRQPSSSSWDSCRGNLQGSSLSLFLDERMAAEKVASIALLDLTGARCERLRGRHGRKHTFSLRLTSGAEILFAAPSEEQAESWWRALGSTAAQSLSPKLKAKPVSSLNECTTKDARPGCLLRSDP

SEQ ID NO: 65122 - protein, 313 aa, Homo sapiens
MRHNQMCCETPPTVTVYVKSGSNRSHQPKKPITLKRPICKDNWQAFEKNTHNNNKSKRPKGPCLVIQRQDMTAFFKLFDDDLIQDFLWMDCCCKIADKYLLAMTFVYFKRAKFTISEHTRINFFIALYLANTVEEDEEETKYEIFPWALGKNWRKLFPNFLKLRDQLWDRIDYRAIVSRRCCEEVMAIAPTHYIWQRERSVHHSGAVRNYNRDEVQLPRGPSATPVDCSLCGKKRRYVRLGLSSSSSLSSHTAGVTEKHSQDSYNSLSMDIIGDPSQAYTGSEVVNDHQSNKGKKTNFLKKDKSMEWFTGSEE

SEQ ID NO: 65123 - protein, 313 aa, Homo sapiens; identical to SEQ ID NO: 65122

SEQ ID NO: 65124 - protein, 127 aa, Homo sapiens
MRHNQMCCETPPTVTVYVKSGSNRSHQPKKPITLKRPICKDNWQAFEKNTHNNNKSKRPKGPCLVIQRQDMTAFFKLFDDDLIQDFLWMDCCCKIADKYLLAMTFVYFKRAKFTISEHTRINFFIAL

SEQ ID NO: 65125 - protein, 293 aa, Homo sapiens
MLWAIPELGSPCPISISYEMSDSQDPTTSPVVTTQVELGGCSRQGGGNGFLRFRQHQEVQAFLSLLEDSFVQEFLSKDPCFQISDKYLLAMVLVYFQRAHLKLSEYTHSSLFLALYLANDMEEDLEGPKCEIFPWALGKDWCLRVGKFLHQRDKLWARMGFRAVVSRQCCEEVMAKEPFHWAWTRDRRPHHGGVQRVCPQVPVRLPRGPGLSPPHCSPCGLPQHCSSHLLKPVSSKCPSLTSECHRPPSQNYLSRVKNAWGGDFLIVLPPQMQLEPGTYSLRIFPKPPARPGH

SEQ ID NO: 65126 - protein, 373 aa, Homo sapiens
MNVDKFLIVCYLKKEVWGFESYSLSGTTCFQWNYFVWSLRFFFSCGSSKYHLTPLPIKKVDYPHKRGQNWGSYVHNSLPRFNWDYRSCFHTWKRASDNRERAYEHSAYGHHERGTGGFDRTRHYDQDYYRDPRERTLQHGLYYASRSRSPNRFDAHDPRYEPRAREQFTLPSVVHRDIYRDDITREVRGRRPERNYQHSRSRSPHSSQSRNQSPQRLASQASRPTRSPSGSGSRSRSSSSDSISSSSSTSSDSSDSSSSSSDDSPARSVQSAAVPAPTSQLLSSLEKDEPRKSFGIKVQNLPVRSTDTSLKDGLFHEFKKFGKVTSVQIHGTSEERYGLVFFRQQEDQEKALTASKGKLFFGMQIEVTAWIGP

SEQ ID NO: 65127 - protein, 3664 aa, Homo sapiens
MVRETRHLWVGNLPENVREEKIIEHFKRYGRVESVKILPKRGSEGGVAAFVDFVDIKSAQKAHNSVNKMGDRDLRTDYNEPGTIPSAARGLDDTVSIASRSREVSGFRGGGGGPAYGPPPSLHAREGRYERRLDGASDNRERAYEHSAYGHHERGTGGFDRTRHYDQDYYRDPRERTLQHGLYYASRSRSPNRFDAHDPRYEPRAREQFTLPSVVHRDIYRDDITREVRGRRPERNYQHSRSRSPHSSQSRNQSPQRLASQASRPTRSPSGSGSRSRSSSSDSISSSSSTSSDSSDSSSSSSDDSPARSVQSAAVPAPTSQLLSSLEKDEPRKSFGIKVQNLPVRSTDTSLKDGLFHEFKKFGKVTSVQIHGTSEERYGLVFFRQQEDQEKALTASKGKLFFGMQIEVTAWIGPETESENEFRPLDERIDEFHPKATRTLFIGNLEKTTTYHDLRNIFQRFGEIVDIDIKKVNGVPQYAFLQYCDIASVCKAIKKMDGEYLGNNRLKLGFGKSMPTNCVWLDGLSSNVSDQYLTRHFCRYGPVVKVVFDRLKGMALVLYNEIEYAQAAVKETKGRKIGGNKIKVDFANRESQLAFYHCMEKSGQDIRDFYEMLAERREERRASYDYNQDRTYYESVRTPGTYPEDSRRDYPARGREFYSEWETYQGDYYESRYYDDPREYRDYRNDPYEQDIREYSYRQRERERERERFESDRDRDHERRPIERSQSPVHLRRPQSPGASPSQAERLPSDSERRLYSRSSDRSGSCSSLSPPRYEKLDKSRLERYTKNEKTDKERTFDPERVERERRLIRKEKVEKDKTDKQKRKGKVHSPSSQSSETDQENEREQSPEKPRSCNKLSREKADKEGIAKNRLELMPCVVLTRVKEKEGKVIDHTPVEKLKAKLDNDTVKSSALDQKLQVSQTEPAKSDLSKLESVRMKVPKEKGLSSHVEVVEKEGRLKARKHLKPEQPADGVSAVDLEKLEARKRRFADSNLKAEKQKPEVKKSSPEMEDARVLSKKQPDVSSREVILLREGEAERKPVRKEILKRESKKIKLDRLNTVASPKDCQELASISVGSGSRPSSDLQARLGELAGESVENQEVQSKKPIPSKPQLKQLQVLDDQGPEREDVRKNYCSLRDETPERKSGQEKSHSVNTEEKIGIDIDHTQSYRKQMEQSRRKQQMEMEIAKSEKFGSPKKDVDEYERRSLVHEVGKPPQDVTDDSPPSKKKRMDHVDFDICTKRERNYRSSRQISEDSERTGGSPSVRHGSFHEDEDPIGSPRLLSVKGSPKVDEKVLPYSNITVREESLKFNPYDSSRREQMADMAKIKLSVLNSEDELNRWDSQMKQDAGRFDVSFPNSIIKRDSLRKRSVRDLEPGEVPSDSDEDGEHKSHSPRASALYESSRLSFLLRDREDKLRERDERLSSSLERNKFYSFALDKTITPDTKALLERAKSLSSSREENWSFLDWDSRFANFRNNKDKEKVDSAPRPIPSWYMKKKKIRTDSEGKMDDKKEDHKEEEQERQELFASRFLHSSIFEQDSKRLQHLERKEEDSDFISGRIYGKQTSEGANSTTDSIQEPVVLFHSRFMELTRMQQKEKEKDQKPKEVEKQEDTENHPKTPESAPENKDSELKTPPSVGPPSVTVVTLESAPSALEKTTGDKTVEAPLVTEEKTVEPATVSEEAKPASEPAPAPVEQLEQVDLPPGADPDKEAAMMPAGVEEGSSGDQPPYLDAKPPTPGASFSQAESNVDPEPDSTQPLSKPAQKSEEANEPKAEKPDATADAEPDANQKAEAAPESQPPASEDLEVDPPVAAKDKKPNKSKRSKTPVQAAAVSIVEKPVTRKSERIDREKLKRSNSPRGEAQKLLELKMEAEKITRTASKNSAADLEHPEPSLPLSRTRRRNVRSVYATMGDHENRSPVKEPVEQPRVTRKRLERELQEAAAVPTTPRRGRPPKTRRRADEEEENEAKEPAETLKPPEGWRSPRSQKTAAGGGPQGKKGKNEPKVDATRPEATTEVGPQIGVKESSMEPKAAEEEAGSEQKRDRKDAGTDKNPPETAPVEVVEKKPAPEKNSKSKRGRSRNSRLAVDKSASLKNVDAAVSPRGAAAQAGERESGVVAVSPEKSESPQKEDGLSSQLKSDPVDPDKEPEKEDVSASGPSPEATQLAKQMELEQAVEHIAKLAEASASAAYKADAPEGLAPEDRDKPAHQASETELAAAIGSIINDISGEPENFPAPPPYPGESQTDLQPPAGAQALQPSEEGMETDEAVSGILETEAATESSRPPVNAPDPSAGPTDTKEARGNSSETSHSVPEAKGSKEVEVTLVRKDKGRQKTTRSRRKRNTNKKVVAPVESHVPESNQAQGESPAANEGTTVQHPEAPQEEKQSEKPHSTPPQSCTSDLSKIPSTENSSQEISVEERTPTKASVPPDLPPPPQPAPVDEEPQARFRVHSIIESDPVTPPSDPSIPIPTLPSVTAAKLSPPVASGGIPHQSPPTKVTEWITRQEEPRAQSTPSPALPPDTKASDVDTSSSTLRKILMDPKYVSATSVTSTSVTTAIAEPVSAAPCLHEAPPPPVDSKKPLEEKTAPPVTNNSEIQASEVLVAADKEKVAPVIAPKITSVISRMPVSIDLENSQKITLAKPAPQTLTGLVSALTGLVNVSLVPVNALKGPVKGSVTTLKSLVSTPAGPVNVLKGPVNVLTGPVNVLTTPVNATVGTVNAAPGTVNAAASAVNATASAVTVTAGAVTAASGGVTATTGTVTMAGAVIAPSTKCKQRASANENSRFHPGSMPVIDDRPADAGSGAGLRVNTSEGVVLLSYSGQKTEGPQRISAKISQIPPASAMDIEFQQSVSKSQVKPDSVTASQPPSKGPQAPAGYANVATHSTLVLTAQTYNASPVISSVKADRPSLEKPEPIHLSVSTPVTQGGTVKVLTQGINTPPVLVHNQLVLTPSIVTTNKKLADPVTLKIETKVLQPANLGSTLTPHHPPALPSKLPTEVNHVPSGPSIPADRTVSHLAAAKLDAHSPRPSGPGPSSFPRASHPSSTASTALSTNATVMLAAGIPVPQFISSIHPEQSVIMPPHSITQTVSLSHLSQGEVRMNTPTLPSITYSIRPEALHSPRAPLQPQQIEVRAPQRASTPQPAPAGVPALASQHPPEEEVHYHLPVARATAPVQSEVLVMQSEYRLHPYTVPRDVRIMVHPHVTAVSEQPRAADGVVKVPPASKAPQQPGKEAAKTPDAKAAPTPTPAPVPVPVPLPAPAPAPHGEARILTVTPSNQLQGLPLTPPVVVTHGVQIVHSSGELFQEYRYGDIRTYHPPAQLTHTQFPAASSVGLPSRTKTAAQGPPPEGEPLQPPQPVQSTQPAQPAPPCPPSQLGQPGQPPSSKMPQVSQEAKGTQTGVEQPRLPAGPANRPPEPHTQVQRAQAETGPTSFPSPVSVSMKPDLPVSLPTQTAPKQPLFVPTTSGPSTPPGLVLPHTEFQPAPKQDSSPHLTSQRPVDMVQLLKKYPIVWQGLLALKNDTAAVQLHFVSGNNVLAHRSLPLSEGGPPLRIAQRMRLEATQLEGVARRMTVETDYCLLLALPCGRDQEDVVSQTESLKAAFITYLQAKQAAGIINVPNPGSNQPAYVLQIFPPCEFSESHLSRLAPDLLASISNISPHLMIVIASV

SEQ ID NO: 65128 - protein, 373 aa, Homo sapiens; identical to SEQ ID NO: 65126

SEQ ID NO: 65129 - protein, 297 aa, Homo sapiens
  MOD_RES (1)..(1): Any amino acid
XQASRPTRSPSGSGSRSRSSSSDSISSSSSTSSDSDSSSSSSDDSPARSVQSAAVPAPTSQLLSSLEKDEPRKSFGIKVQNLPVRSTDTSLKDGLFHEFKKFGKVTSVQIHGTSEERYGLVFFRQQEDQEKALTASKGKLFFGMQIEVTAWIGPETESENEFRPLDERIDEFHPKATRTLFIGNLEKTTTYHDLRNIFQRFGEIVDIDIKKVNGVPQYAFLQYCDIASVCKAIKKMDGEYLGNNRLKLGFGKSMPTNCVWLDGLSSNVSDQYLTRHFCRYGPVVKVVFDRLKGMALV

SEQ ID NO: 65130 - protein, 294 aa, Homo sapiens
MSPRGTGCSAGLLMTVGWLLLAGLQSARGTNVTAAVQDAGLAHEGEGEEETENNDSETAENYAPPETEDVSNRNVVKEVEFGMCTVTCGIGVREVILTNGCPGGESKCVVRVEECRGPTDCGWGKPISESLESVRLACIHTSPLNRFKYMWKLLRQDQQSIILVNDSAILEVRKESHPLAFECDTLDNNEIVATIKFTVYTSSELQMRRSSLPATDAALIFVLTIGVIICVFIIFLLIFIIINWAAVKAFWGAKASTPEVQSEQSSVRYKDSTSLDQLPTEMPGEDDALSEWNE

SEQ ID NO: 65131 - protein, 215 aa, Homo sapiens [sequence omitted]

SEQ ID NO: 65132 - protein, 208 aa, Homo sapiens
MIQEDHEGSQDGGVHSSPVSSPSVSGPRRLVSCLSSQSSALSQSGGGSTSAAGIEARSRALRRRWCPAGIMLLALVCLLSCLLPSSEAKLYGRCELARVLHDFGLDGYRGYSLADWVCLAYFTSGFNAAALDYEADGSTNNGIFQINSRRWCSNLTPNVPNVCRMYCSDLLNPNLKDTVICAMKITQEPQGLGYWEAWRHHCQGKDLT

SEQ ID NO: 65133 - protein, 112 aa, Homo sapiens
MVSALRGAPLIRVCLAYFTSGFNAAALDYEADGSTNNGIFQINSRRWCSNLTPNVPNVCRMYCSDLLNPNLKDTVICAMKITQEPQGLGYWEAWRHHCQGKDLTEWVDGCDF

SEQ ID NO: 65134 - protein, 123 aa, Homo sapiens
MTSGWTDTGDTAWLTAYALPYAGVCLAYFTSGFNAAALDYEADGSTNNGIFQINSRRWCSNLTPNVPNVCRMYCSDLLNPNLKDTVICAMKITQEPQGLGYWEAWRHHCQGKDLTEWVDGCDF

SEQ ID NO: 65135 - protein, 124 aa, Homo sapiens
MVLCWLLLLVMALPPGTTGVKDCVFCELTDSMQCPGTYMHCGDDEDCFTGHGVAPGTGPVINKGCLRATSCGLEEPVSYRGVTYSLTTNCCTGRLCNRAPSSQTVGATTSLALGLGMLLPPRLL

SEQ ID NO: 65136 - protein, 159 aa, Homo sapiens
MKAWGTVVVTLATLMVVTVDAKIYERCELAARLERAGLNGYKGYGVGDWLCMAHYESGFDTAFVDHNPDGSSEYGIFQLNSAWWCDNGITPTKNLCHMDCHDLLNRHILDDIRCAKQIVSSQNGLSAWTSWRLHCSGHDLSEWLKGCDMHVKIDPKIHP

SEQ ID NO: 65137 - protein, 159 aa, Homo sapiens; identical to SEQ ID NO: 65136

SEQ ID NO: 65138 - protein, 1068 aa, Homo sapiens
MRSAAKPWNPAIRAGGHGPDRVRPLPAASSGMKSSKSSTSLAFESRLSRLKRASSEDTLNKPGSTAASGVVRLKKTATAGAISELTESRLRSGTGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPPVDEEPESSEVDAAGRWPGVCVSRTSPTPPESATTVKSLIKSFDLGRPGGAGQNISVHKTPRSPLSGIPVRTAPAAAVSPMQRHSTYSSVRPASRGVTQRLDLPDLPLSDILKGRTETLKPDPHLRKSPSLESLSRPPSLGFGDTRLLSASTRAWKPQSKLSVERKDPLAALAREYGGSKRNALLKWCQKKTQGYANIDITNFSSSWSDGLAFCALLHTYLPAHIPYQELNSQEKKRNLLLAFEAAESVGIKPSLELSEMLYTDRPDWQSVMQYVAQIYKYFET

SEQ ID NO: 65139 - protein, 703 aa, Homo sapiens
MGNHSGRPEDPEPGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPP

SEQ ID NO: 65140 - protein, 709 aa, Homo sapiens
MGNHSGRPEDPEPGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPSLGSVS

SEQ ID NO: 65141 - protein, 987 aa, Homo sapiens
MGNHSGRPEDPEPGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPPVDEEPESSEVDAAGRWPGVCVSRTSPTPPESATTVKSLIKSFDLGRPGGAGQNISVHKTPRSPLSGIPVRTAPAAAVSPMQRHSTYSSVRPASRGVTQRLDLPDLPLSDILKGRTETLKPDPHLRKSPSLESLSRPPSLGFGDTRLLSASTRAWKPQSKLSVERKDPLAALAREYGGSKRNALLKWCQKKTQGYANIDITNFSSSWSDGLAFCALLHTYLPAHIPYQELNSQEKKRNLLLAFEAAESVGIKPSLELSEMLYTDRPDWQSVMQYVAQIYKYFET

SEQ ID NO: 65142 - protein, 790 aa, Homo sapiens
MRSAAKPWNPAIRAGGHGPDRVRPLPAASSGMKSSKSSTSLAFESRLSRLKRASSEDTLNKPGSTAASGVVRLKKTATAGAISELTESRLRSGTGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPSLGSVS

SEQ ID NO: 65143 - protein, 1029 aa, Homo sapiens
MRSAAKPWNPAIRAGGHGPDRVRPLPAASSGMKSSKSSTSLAFESRLSRLKRASSEDTLNKPGSTAASGVVRLKKTATAGAISELTESRLRSGTGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPPVDEEPESSEVDAAGRWPGVCVSRTSPTPPESATTVKSLIKSFDLGRPGGAGQNISVHKTPRSPLSGIPVRTAPAAAVSPMQRHSTYSSVRPASRGVTQRLDLPDLPLSDILKGRTETLKPDPHLRKSPSLESLSRPPSLGFGDTRLLSASTRAWKPQSKLSVERKDPLAALAREYGGSKRNALLKWCQKKTQGYAKRNLLLAFEAAESVGIKPSLELSEMLYTDRPDWQSVMQYVAQIYKYFET

SEQ ID NO: 65144 - protein, 78 aa, Homo sapiens
MRSAAKPWNPAIRAGGHGPDRVRPLPAASSGMKSSKSSTSLAFESRLSRLKRASSEDTLNKPGSTAASGVVRLKKTAT

SEQ ID NO: 65145 - protein, 408 aa, Homo sapiens
MKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPPVDEEPESSEVDAAGRWPGVCVSRTSPTPPESATTVKSLIKSFDLGRPGGAGQNISVHKTPRSPLSGIPVRTAPAAAVSPMQRHSTYSSVRPASRGVTQRLDLPDLPLSDILKGRTETLKPDPHLRKSPSLESLSRPPSLGFGDTRLLSASTRAWKPQSKLSVERKDPLAALAREYGGSKRNALLKWCQKKTQGYANIDITNFSSSWSDGLAFCALLHTYLPAHIPYQELNSQEKKRNLLLAFEAAESVGIKPSLELSEMLYTDRPDWQSVMQYVAQIYKYFET

SEQ ID NO: 65146 - protein, 1117 aa, Homo sapiens
MKKASRSVGSVPKVSAISKTQTAEKIKPENSSSASTGGKLVKPGTAASLSKTKSSDDLLAGMAGGVTVTNGVKGKKSTCPSAAPSASAPAMTTVENKSKISTGTASSTKRSTSTGNKESSSTRERLRERTRLNQSKKLPSAGQGANDMALAKRSRSRTATECDVRMSKSKSDNQISDRAALEAKVKDLLTLAKTKDVEILHLRNELRDMRAQLGINEDHSEGDEKSEKETIMAHQPTDVESTLLQLQEQNTAIREELNQLKNENRMLKDRLNALGFSLEQRLDNSEKLFGYQSLSPEITPDNQSDGGGTLTSSVEGSAPGSVEDLLSQDENTLMDHQHSNSMDNLDSECSEVYQPLTSSDDALDAPSSSESEGIPSIERSRKGSSGNASEVSVACLTERIHQMEENQHSTSEELQATLQELADLQQITQELNSENERLGEEKVILMESLCQQSDKLEHFSRQIEYFRSLLDEHHISYVIDEDVKSGRYMELEQRYMDLAENARFEREQLLGVQQHLSNTLKMAEQDNKEAQEMIGALKERSHHMERIIESEQKGKAALAATLEEYKATVASDQIEMNRLKAQLENEKQKVAELYSIHNSGDKSDIQDLLESVRLDKEKAETLASSLQEDLAHTRNDANRLQDAIAKVEDEYRAFQEEAKKQIEDLNMTLEKLRSDLDEKETERSDMKETIFELEDEVEQHRAVKLHDNLIISDLENTVKKLQDQKHDMEREIKTLHRRLREESAEWRQFQADLQTAVVIANDIKSEAQEEIGDLKRRLHEAQEKNEKLTKELEEIKSRKQEEERGRVYNYMNAVERDLAALRQGMGLSRRSSTSSEPTPTVKTLIKSFDSASQVPNPAAAAIPRTPLSPSPMKTPPAAAVSPMQRHSISGPISTSKPLTALSDKRPNYGEIPVQEHLLRTSSASRPASLPRVPAMESAKTLSVSRRSSEEVKRDISAQEGASPASLMAMGTTSPQLSLSSSPTASVTPTTRSRIREERKDPLSALAREYGGSKRNALLKWCQKKTEGYQNIDITNFSSSWNDGLAFCALLHTYLPAHIPYQELNSQDKRRNFMLAFQAAESVGIKSTLDINEMVRTERPDWQNVMLYVTAIYKYFET

SEQ ID NO: 65147 - protein, 939 aa, Homo sapiens
VPEAVRWGYFIPEQSQFACKCITKRQPRMKKASRSVGSVPKVSAISKTQTAEKIKPENSSSASTGGKLVKPGTAASLSKTKSSDDLLAGMAGGVTVTNGVKGKKSTCPSAAPSASAPAMTTVENKSKISTGTASSTKRSTSTGNKESSSTRERLRERTRLNQSKKLPSAGQGANDMALAKRSRSRTATECDVRMSKSKSDNQISDRAALEAKVKDLLTLAKTKDVEILHLRNELRDMRAQLGINEDHSEGDEKSEKETIMAHQPTDVESTLLQLQEQNTAIREELNQLKNENRMLKDRLNALGFSLEQRLDNSEKLFGYQSLSPEITPDNQSDGGGTLTSSVEGSAPGSVEDLLSQDENTLMDHQHSNSMDNLDSECSEVYQPLTSSDDALDAPSSSESEGIPSIERSRKGSSGNASEVSVACLTERIHQMEENQHSTSEELQATLQELADLQQITQELNSENERLGEEKVILMESLCQQSDKLEHFSRQIEYFRSLLDEHHISYVIDEDVKSGRYMELEQRYMDLAENARFEREQLLGVQQHLSNTLKMAEQDNKEAQEMIGALKERSHHMERIIESEQKGKAALAATLEEYKATVASDQIEMNRLKAQLENEKQKVAELYSIHNSGDKSDIQDLLESVRLDKEKAETLASSLQEDLAHTRNDANRLQDAIAKVEDEYRAFQEEAKKQIEDLNMTLEKLRSDLDEKETERSDMKETIFELEDEVEQHRAVKLHDNLIISDLENTVKKLQDQKHDMEREIKTLHRRLREESAEWRQFQADLQTAVVIANDIKSEAQEEIGDLKRRLHEAQEKNEKLTKELEEIKSRKQEEERGRVYNYMNAVERDLAALRQGMGLSRRSSTSSEPTPTVKTLIKSFDSASQVPNPAAAAIPRTPLSPSPMKTPPAAAVSPMQMESSSVAHAGMQWRDLGSLQPLPPGFK

SEQ ID NO: 65148 - protein, 789 aa, Homo sapiens
MKKASRSVGSVPKVSAISKTQTAEKIKPENSSSASTGGKLVKPGTAASLSKTKSSDDLLAGMAGGVTVTNGVKGKKSTCPSAAPSASAPAMTTVENKSKISTGTASSTKRSTSTGNKESSSTRERLRERTRLNQSKKLPSAGQGANDMALAKRSRSRTATECDVRMSKSKSDNQISDRAALEAKVKDLLTLAKTKDVEILHLRNELRDMRAQLGINEDHSEGDEKSEKETIMAHQPTDVESTLLQLQEQNTAIREELNQLKNENRMLKDRLNALGFSLEQRLDNSEKLFGYQSLSPEITPDNQSDGGGTLTSSVEGSAPGSVEDLLSQDENTLMDHQHSNSMDNLDSECSEVYQPLTSSDDALDAPSSSESEGIPSIERSRKGSSGNASEVSVACLTERIHQMEENQHSTSEELQATLQELADLQQITQELNSENERLGEEKVILMESLCQQSDKLEHFSRQIEYFRSLLDEHHISYVIDEDVKSGRYMELEQRYMDLAENARFEREQLLGVQQHLSNTLKMAEQDNKEAQEMIGALKERSHHMERIIESEQKGKAALAATLEEYKATVASDQIEMNRLKAQLENEKQKVAELYSIHNSGDKSDIQDLLESVRLDKEKAETLASSLQEDLAHTRNDANRLQDAIAKVEDEYRAFQEEAKKQIEDLNMTLEKLRSDLDEKETERSDMKETIFELEDEVEQHRAVKLHDNLIISDLENTVKKLQDQKHDMEREIKTLHRRLREESAEWRQFQADLQTAVVIANDIKSEAQEEIGDLKRRLHEAQEKNEKLT

SEQ ID NO: 65149 - protein, 1117 aa, Homo sapiens; identical to SEQ ID NO: 65146

SEQ ID NO: 65150 - protein, 1078 aa, Homo sapiens
MKKASRSVGSVPKVSAISKTQTAEKIKPENSSSASTGGKLVKPGTAASLSKTKSSDDLLAGMAGGVTVTNGVKGKKSTCPSAAPSASAPAMTTVENKSKISTGTASSTKRSTSTGNKESSSTRERLRERTRLNQSKKLPSAGQGANDMALAKRSRSRTATECDVRMSKSKSDNQISDRAALEAKVKDLLTLAKTKDVEILHLRNELRDMRAQLGINEDHSEGDEKSEKETIMAHQPTDVESTLLQLQEQNTAIREELNQLKNENRMLKDRLNALGFSLEQRLDNSEKLFGYQSLSPEITPDNQSDGGGTLTSSVEGSAPGSVEDLLSQDENTLMDHQHSNSMDNLDSECSEVYQPLTSSDDALDAPSSSESEGIPSIERSRKGSSGNASEVSVACLTERIHQMEENQHSTSEELQATLQELADLQQITQELNSENERLGEEKVILMESLCQQSDKLEHFSRQIEYFRSLLDEHHISYVIDEDVKSGRYMELEQRYMDLAENARFEREQLLGVQQHLSNTLKMAEQDNKEAQEMIGALKERSHHMERIIESEQKGKAALAATLEEYKATVASDQIEMNRLKAQLENEKQKVAELYSIHNSGDKSDIQDLLESVRLDKEKAETLASSLQEDLAHTRNDANRLQDAIAKVEDEYRAFQEEAKKQIEDLNMTLEKLRSDLDEKETERSDMKETIFELEDEVEQHRAVKLHDNLIISDLENTVKKLQDQKHDMEREIKTLHRRLREESAEWRQFQADLQTAVVIANDIKSEAQEEIGDLKRRLHEAQEKNEKLTKELEEIKSRKQEEERGRVYNYMNAVERDLAALRQGMGLSRRSSTSSEPTPTVKTLIKSFDSASQVPNPAAAAIPRTPLSPSPMKTPPAAAVSPMQRHSISGPISTSKPLTALSDKRPNYGEIPVQEHLLRTSSASRPASLPRVPAMESAKTLSVSRRSSEEVKRDISAQEGASPASLMAMGTTSPQLSLSSSPTASVTPTTRSRIREERKDPLSALAREYGGSKRNALLKWCQKKTEGYQRRNFMLAFQAAESVGIKSTLDINEMVRTERPDWQNVMLYVTAIYKYFET

SEQ ID NO: 65151 - protein, 926 aa, Homo sapiens
MTTKDYPSLWGFGTTKTFKIPIEHLDFKYIEKCSDVKHLEKILCVLRSGEEGYYPELTEFCEKHLQALAPESRALRKDKPAATAASFTAEEWEKIDGDIKSWVSEIKKEEDKMHFHETETFPAMKDNLPPVRGSNSCLHVGKEKYSKRPTKKKTPRDYAEWDKFDVEKECLKIDEDYKEKTVIDKSHLSKIETRIDTAGLTEKEKDFLATREKEKGNEAFNSGDYEEAVMYYTRSISALPTVVAYNNRAQAEIKLQNWNSAFQDCEKVLELEPGNVKALLRRATTYKHQNKLREATEDLSKVLDVEPDNDLAKKTLSEVERDLKNSEAASETQTKGKRMVIQEIENSEDEEGKSGRKHEDGGGDKKPAEPAGAARAAQPCVMGNIQKKLTGKAEGGKRPARGAPQRGQTPEAGADKRSPRRASAAAAAGGGATGHPGGGQGAENPAGLKSQGNELFRSGQFAEAAGKYSAAIALLEPAGSEIADDLSILYSNRAACYLKEGNCSGCIQDCNRALELHPFSMKPLLRRAMAYETLEQYGKAYVDYKTVLQIDCGLQLANDSVNRLSRILMELDGPNWREKLSPIPAVPASVPLQAWHPAKEMISKQAGDSSSHRQQGITDEKTFKALKEEGNQCVNDKNYKDALSKYSECLKINNKECAIYTNRALCYLKLCQFEEAKQDCDQALQLADGNVKAFYRRALAHKGLKNYQKSLIDLNKVILLDPSIIEAKMELEEVTRLLNLKDKTAPFNKEKERRKIEIQEVNEGKEEPGRPAGEVSMGCLASEKGGKSSRSPEDPEKLPIAKPNNAYEFGQIINALSTRKDKEACAHLLAITAPKDLPMFLSNKLEGDTFLLLIQSLKNNLIEKDPSLVYQHLLYLSKAERFKMMLTLISKGQKELIEQLFEDLSDTPNNHFTLEDIQALKRQYEL

SEQ ID NO: 65152 - protein, 926 aa, Homo sapiens; identical to SEQ ID NO: 65151

SEQ ID NO: 65153 - protein, 347 aa, Homo sapiens
MAAQRGMPSSAVRVLEEALGMGLTAAGDARDTADAVAAEGAYYLEQVTITEASEDDYEYEEIPDDNFSIPEGEEDLAKAIQMAQEQATDTEILERKTVLPSKHAVPEVIEDFLCNFLIKMGMTRTLDCFQSEWYELIQKGVTELRTVGNVPDVYTQIMLLENENKNLKKDLKHYKQAADKAREDLLKIQKERDFHRMHHKRIVQEKNKLINDLKGLKLHYASYEPTIRVLHEKHHTLLKEKMLTSLERDKVVGQISGLQETLKKLQRGHSYHGPQIKVDHSREKENAPEGPTQKGLREAREQNKCKTKMKGNTKQWTGNSQTWNKTVPLQDTIGRRQENNSAHQHID

SEQ ID NO: 65154 - protein, 631 aa, Homo sapiens
MAAQRGMPSSAVRVLEEALGMGLTAAGDARDTADAVAAEGAYYLEQVTITEASEDDYEYEEIPDDNFSIPEGEEDLAKAIQMAQEQATDTEILERKTVLPSKHAVPEVIEDFLCNFLIKMGMTRTLDCFQSEWYELIQKGVTELRTVGNVPDVYTQIMLLENENKNLKKDLKHYKQAADKAREDLLKIQKERDFHRMHHKRIVQEKNKLINDLKGLKLHYASYEPTIRVLHEKHHTLLKEKMLTSLERDKVVGQISGLQETLKKLQRGHSYHGPQIKVDHSREKENAPEGPTQKGLREAREQNKCKTKMKGNTKDSEFPIDMQPNPNLNVSKESLSPAKFDYKLKNIFRLHELPVSCVSMQPHKDILVSCGEDRLWKVLGLPKCNVLLTGFGHTDWLSDCCFHPSGDKLATSSGDTTVKLWDLCKGDCILTFEGHSRAVWSCTWHSCGNFVASSSLDKTSKIWDVNSERCRCTLYGHTDSVNSIEFFPFSNTLLTSSADKTLSIWDARTGICEQSLYGHMHSINDAIFDPRGHMIASCDACGVTKLWDFRKLLPIVSIDIGPSPGNEVNFDSSGRVLAQASGNGVIHLLDLKSGEIHKLMGHENEAHTVVFSHDGEILFSGGSDGTVRTWS

SEQ ID NO: 65155 - protein, 537 aa, Homo sapiens
MTMNMKRYQMTILASQKVKKIWQKQFRWPKNRLQILKFWYELIQKGVTELRTVGNVPDVYTQIMLLENENKNLKKDLKHYKQAADKAREDLLKIQKERDFHRMHHKRIVQEKNKLINDLKGLKLHYASYEPTIRVLHEKHHTLLKEKMLTSLERDKVVGQISGLQETLKKLQRGHSYHGPQIKVDHSREKENAPEGPTQKGLREAREQNKCKTKMKGNTKDSEFPIDMQPNPNLNVSKESLSPAKFDYKLKNIFRLHELPVSCVSMQPHKDILVSCGEDRLWKVLGLPKCNVLLTGFGHTDWLSDCCFHPSGDKLATSSGDTTVKLWDLCKGDCILTFEGHSRAVWSCTWHSCGNFVASSSLDKTSKIWDVNSERCRCTLYGHTDSVNSIEFFPFSNTLLTSSADKTLSIWDARTGICEQSLYGHMHSINDAIFDPRGHMIASCDACGVTKLWDFRKLLPIVSIDIGPSPGNEVNFDSSGRVLAQASGNGVIHLLDLKSGEIHKLMGHENEAHTVVFSHDGEILFSGGSDGTVRTWS

SEQ ID NO: 65156 - protein, 251 aa, Homo sapiens
MGVGTKARASHWRRLLSLGATPEEPLLDFKIPDDNFSIPEGEEDLAKAIQMAQEQATDTEILERKTVLPSKHAVPEVIEDFLCNFLIKMGMTRTLDCFQSEWYELIQKGVTELRTVGNVPDVYTQIMLLENENKNLKKDLKHYKQAADKAREDLLKIQKERDFHRMHHKRIVQEKNKLINDLKGLKLHYASYEPTIRVLHEKHHTLLKEKMLTSLERDKVVGQISGLQETLKKLQRGHSYHGPQIKGKCKM

SEQ ID NO: 65157 - protein, 183 aa, Homo sapiens
MAAQRGMPSSAVRVLEEALGMGLTAAGDARDTADAVAAEGAYYLEQVTITEASEDDYEYEEIPDDNFSIPEGEEDLAKAIQMAQEQATDTEILERKTVLPSKHAVPEVIEDFLCNFLIKMGMTRTLDCFQSEWYELIQKGVTELRTVGNVPDVYTQIMLLENENKNLKKDLKHYKQAAEYVIF

SEQ ID NO: 65158 - protein, 255 aa, Homo sapiens
DSEFPIDMQPNPNLNVSKESLSPAKFDYKLKNIFRLHELPVSCVSMQPHKDILVSCGEDRLWKVLGLPKCNVLLTGFGHTDWLSDCCFHPSERCRCTLYGHTDSVNSIEFFPFSNTLLTSSADKTLSIWDARTGICEQSLYGHMHSINDAIFDPRGHMIASCDACGVTKLWDFRKLLPIVSIDIGPSPGNEVNFDSSGRVLAQASGNGVIHLLDLKSGEIHKLMGHENEAHTVVFSHDGEILFSGGSDGTVRTWS

SEQ ID NO: 65159 - protein, 437 aa, Homo sapiens
MRRSSRPGSASSSRKHTPNFFSENSSMSITSEDSKGLRSAEPGPGEPEGRRARGPSCGEPALSAGVPGGTTWAGSSQQKPAPRSHNWQTACGAATVRGGASEPTGSPVVSEEPLDLLPTLDLRQEMPPPRVFKSFLSLLFQGLSVLLSLAGDVLVSMYREVCSIRFLFTAVSLLSLFLSAFWLGLLYLVSPLENEPKEMLTLSEYHERVRSQGQQLQQLQAELDKLHKEVSTVRAANSERVAKLVFQRLNEDFVRKPDYALSSVGASIDLQKTSHDYADRNTAYFWNRFSFWNYARPPTVILEPHVFPGNCWAFEGDQGQVVIQLPGRVQLSDITLQHPPPSVEHTGGANSAPRDFAVFGLQVYDETEVSLGKFTFDVEKSEIQTFHLQNDPPAAFPKVKIQILSNWGHPRFTCLYRVRAHGVRTSEGAEGSAQGPH

SEQ ID NO: 65160 - protein, 458 aa, Homo sapiens
MSQRQVLQVFEQYQKARTQFVQMVAELATRPQNIETLQNAGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVPLLVLCIQEPEIALKRIAASALSDIAKHSPELAQTVVDAGAVAHLAQMILNPDAKLKHQILSALSQVSKHSVDLAEMVVEAEIFPVVLTCLKDKDEYVKKNASTLIREIAKHTPELSQLVVNAGGVAAVIDCIGSCKGNTRLPGIMMLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLFPWIFRYTSAEGGQLSTT

SEQ ID NO: 65161 - protein, 270 aa, Homo sapiens
MSQRQVLQVFEQYQKARTQFVQMVAELATRPQNIETLQNAGVMSLLRTLLLDVVPTIQQTAALALGRLANYNDDLAEAVVKCDILPQLVYSLAEQNGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLPHDSKARRLFVTSGGLKKVQEIKAEPGSLLQEYINSINSCYPEEIVRYYSPGYSDTLLQRVDSYQPLNN

SEQ ID NO: 65162 - protein, 585 aa, Homo sapiens
MSQRQVLQVFEQYQKARTQFVQMVAELATRPQNIETLQNAGEPGARTPVAPRALSPRRLRPAALPVELLGSRSVGTGVRKSIHSFQRVFGGQAERVKLPDGCGRCALSLFPSSLHTGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVPLLVLCIQEPEIALKRIAASALSDIAKHSPELAQTVVDAGAVAHLAQMILNPDAKLKHQILSALSQVSKHSVDLAEMVVEAEIFPVVLTCLKDKDEYVKKNASTLIREIAKHTPELSQLVVNAGGVAAVIDCIGSCKGNTRLPGIMMLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLPHDSKARRLFVTSGGLKKVQEIKAEPGSLLQEYINSINSCYPEEIVRYYSPGYSDTLLQRVDSYQPLNN

SEQ ID NO: 65163 - protein, 509 aa, Homo sapiens
MSQRQVLQVFEQYQKARTQFVQMVAELATRPQNIETLQNAGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVPLLVLCIQEPEIALKRIAASALSDIAKHSPELAQTVVDAGAVAHLAQMILNPDAKLKHQILSALSQVSKHSVDLAEMVVEAEIFPVVLTCLKDKDEYVKKNASTLIREIAKHTPELSQLVVNAGGVAAVIDCIGSCKGNTRLPGIMMLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLPHDSKARRLFVTSGGLKKVQEIKAEPGSLLQEYINSINSCYPEEIVRYYSPGYSDTLLQRVDSYQPLNN

SEQ ID NO: 65164 - protein, 246 aa, Homo sapiens
MSQRQVLQVFEQYQKARTQFVQMVAELATRPQNIETLQNAGEPGARTPVAPRALSPRRLRPAALPVELLGSRSVGTGVRKSIHSFQRVFGGQAERVKLPDGCGRCALSLFPSSLHTGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVP

SEQ ID NO: 65165 - protein, 191 aa, Homo sapiens
MSQRQVLQVFEQYQKARTQFVQMVAELATRPQNIETLQNAGVMSLLRTLLLDVVPTIQQTAALALGRLANYNDDLAEAVVKCDILPQLVYSLAEQNGVPQLSVCLSEEPEDHIKAAAAWALGQIGRHTPEHARAVAVTNTLPVLLSLYMSTESSEDLQVKSKKAIKNILQKCTYLPALEPFLYDAPPNILK

SEQ ID NO: 65166 - protein, 484 aa, Homo sapiens
MHSLTMDLWIPNGQAGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVPLLVLCIQEPEIALKRIAASALSDIAKHSPELAQTVVDAGAVAHLAQMILNPDAKLKHQILSALSQVSKHSVDLAEMVVEAEIFPVVLTCLKDKDEYVKKNASTLIREIAKHTPELSQLVVNAGGVAAVIDCIGSCKGNTRLPGIMMLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLPHDSKARRLFVTSGGLKKVQEIKAEPGSLLQEYINSINSCYPEEIVRYYSPGYSDTLLQRVDSYQPLNN

SEQ ID NO: 65167 - protein, 501 aa, Homo sapiens
METNESTEGSRSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKPHDYRQEQPETFWIQRAPQLPTWWPLPTQVPAAEDYLTWKEWGFTGVQEVLSALLRATPGEYSVNICGMNEHPVCSRTWTNRLCHQEMGSKKTVTQEDRGW

SEQ ID NO: 65168 - protein, 485 aa, Homo sapiens
METNESTEGSRSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKPHDYRQEQPETFWIQRAPQLPGVSNIRTLDTPFRKNCSFSTPVPLSLGKLLPYEPENYPYQLGEISSLPCPGGRLGGGGGRMTPF

SEQ ID NO: 65169 - protein, 426 aa, Homo sapiens
METNESTEGSRSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKPHDYRQEQPETFWIQRAPQLPVCEGD

SEQ ID NO: 65170 - protein, 1321 aa, Homo sapiens
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKVSNSPEPQKAVEQEDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 65171 - protein, 1307 aa, Homo sapiens
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 65172 - protein, 635 aa, Homo sapiens
SLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVLHSSLGDGARPCLKTDKQAKNRLKSGFH

SEQ ID NO: 65173 - protein, 1068 aa, Homo sapiens
SLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFVPTRFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 65174 - protein, 1078 aa, Homo sapiens
SVKVSNSPEPQKAVEQEDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 65175 - protein, 1311 aa, Homo sapiens
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFVPTRFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 65176 - protein, 1177 aa, Homo sapiens
MSPGCMLLFVFGFVGGAVVINSAILVSLSVLLLVHFSISTGVPALTQNLPRILRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETVILHQGRLLGLRANKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 65177 - protein, 919 aa, Homo sapiens
MVMRWGERNDVIAWELLQDGVENALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 65178 - protein, 274 aa, Homo sapiens
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQSAMSPGCMLLFVFGFVGGAVVINSAILVSLSVLLLVHFSISTGVPALTQNLPRILRKERPISLGIFPLPAGDGLLTPDAQKGGETPGSEQWKFQELSQPRSHTSLKVSNSPEPQKAVEQEVRMVLLNILQKVY

SEQ ID NO: 65179 - protein, 350 aa, Homo sapiens
MKPLVLLVALLLWPSSVPAYPSITVTPDEEQNLNHYIQVLENLVRSVPSGEPGREKKSNSPKHVYSIASKGSKFKELVTHGDASTENDVLTNPISEETTTFPTGGFTPEIGKKKHTESTPFWSIKPNNVSIVLHAEEPYIENEEPEPEPEPAAKQTEAPRMLPVVTESSTSPYVTSYKSPVTTLDKSTGIGISTESEDVPQLSGETAIEKPEEFGKHPESWNNDDILKKILDINSQVQQALLSDTSNPAYREDIEASKDHLKRSLALAAAAEHKLKTMYKSQLLPVGRTSNKIDDIETVINMLCNSRSKLYEYLDIKCVPPEMREKAATVFNTLKNMCRSRRVTALLKVY

SEQ ID NO: 65180 - protein, 236 aa, Homo sapiens
MASSVDEEALHQLYLWVDNIPLSRPKRNLSRDFSDGVLVAEVIKFYFPKMVEMHNYVPANSLQQKLSNWGHLNRKVLKRLNFSVPDDVMRKIAQCAPGVVELVLIPLRQRLEERQRRRKQGAGSLQELAPQDGSGYMDVGVSQKARGEGVPDPQGGGQLSWDRPPAPRPPAYNRALQGDPSFVLQIAEKEQELLASQETVQVLQMKVRRLEHLLQLKNVRIEDLSRRLQQAERKQR

SEQ ID NO: 65181 - protein, 116 aa, Homo sapiens
MCDQTKHSKCCPAKGNQCCPPQQNQCCQSKGNQCCPPKQNQCCQPKGSQCCPPKHNHCCQPKPPCCIQARCCGLETKPEVSPLNMESEPNSPQTQDKGCQTQQQPHSPQNESRPSK

SEQ ID NO: 65182 - protein, 97 aa, Homo sapiens; identical to SEQ ID NO: 65024

SEQ ID NO: 65183 - protein, 672 aa, Homo sapiens
MRSIRSFANDDRHVMVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQKLTEEKYQVEQCVNEASIIIRNTKEPTLTLKVILTSPLIRDELEKKDGENVSMKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVLQAMGYPTGFDADIECMSSDEKSDNESKNETVSSNSSNNTGNSTTETSSTLEVRTQGPILTASGKNPVMELNEKRRGLKYELISETGGSHDKRFVMEVEVDGQKFRGAGPNKKVAKASAALAALEKLFSGPNAANNKKKKIIPQAKGVVNTAVSAAVQAVRGRGRGTLTRGAFVGATAAPGYIAPGYGTPYGYSTAAPAYGLPKRMVLLPVMKFPTYPVPHYSFF

SEQ ID NO: 65184 - protein, 658 aa, Homo sapiens
MVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQKLTEEKYQVEQCVNEASIIIRNTKEPTLTLKVILTSPLIRDELEKKDGENVSMKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVLQAMGYPTGFDADIECMSSDEKSDNESKNETVSSNSSNNTGNSTTETSSTLEVRTQGPILTASGKNPVMELNEKRRGLKYELISETGGSHDKRFVMEVEVDGQKFRGAGPNKKVAKASAALAALEKLFSGPNAANNKKKKIIPQAKGVVNTAVSAAVQAVRGRGRGTLTRGAFVGATAAPGYIAPGYGTPYGYSTAAPAYGLPKRMVLLPVMKFPTYPVPHYSFF

SEQ ID NO: 65185 - protein, 94 aa, Homo sapiens
MRSIRSFANDDRHVMVKHSTIYPSPEELEAVQNMVSTVECALKHVSDWLDETNKGTKTEGETEVKKDEAGENYSKWSDIVWCNEDWPGCKRLAD

SEQ ID NO: 65186 - protein, 672 aa, Homo sapiens; identical to SEQ ID NO: 65183

SEQ ID NO: 65187 - protein, 74 aa, Homo sapiens
MRSIRSFANDDRHVMVKHSTIYPSPEELEAVQNMVSTVECALKHVSDWLDETNKGTKTEGETEVKKDEAGENYS

SEQ ID NO: 65188 - protein, 591 aa, Homo sapiens
MSLLTNYEGLRHQIERLVRENEELKKLVRLIRENHELKSAIKTQAGGLGISGFTSGLGEATAGLSSRQNNGVFLPPSPAVANERVLEEVGIMALAPLAEMLTSLQPSATPGSLMSPLTGTLSTLLSGPAPTSQSSPLTSFLTSPIAGPLTGTLASSLGLPSTGTLTPSSLVAGPVAMSQSSPLIAPVMGTVAVSLSSPLLSSTATPPGVSQNLLANPMSNLVLPEAPRLRLAEPLRGGPTGPQSPACVVPTATTKVPLSTEPPQSTQDPEPLSMAFAGAPLQTSTPIGAMGTPAPKTAFSFNTSDTQAQPSAAQEQVVPASVPTSPTTSPTVTVLASAPALAPQVATSYTPSSTTHIAQGAPHPPSRMHNSPTQNLPVPHCPPHNAHSPPRTSSSPASVNDSRGPRTTEPSTKSMMEVERKLAHRKTSKFPENPRESKQLAWERLVGEIAFQLDRRILSSIFPERVRLYGFTVSNIPEKIIQASLNPSDHKLDEKLCQRLTQRYVSVMNRLQSLGYNGRVHPALTEQLVNAYGILRERPELAASEGGPYTVDFLQRVVVETVHPGMLADALLLLSCLSQLAHDDGKPMFIW

SEQ ID NO: 65189 - protein, 441 aa, Homo sapiens
MSLLTNYEGLRHQIERLVRENEELKKLVRLIRENHELKSAIKTQAGGLGISGFTSGLGEATAGLSSRQNNGVFLPPSPAVANERVLEEVGIMALAPLAEMLTSLQPSATPGSLMSPLTGTLSTLLSGPAPTSQSSPLTSFLTSPIAGPLTGTLASSLGLPSTGTLTPSSLVAGPVAMSQSSPLIAPVMGTVAVSLSSPLLSSTATPPGVSQNLLANPMSNLVLPEAPRLRLAEPLRGGPTGPQSPACVVPTATTKVPLSTEPPQSTQDPEPLSMAFAGAPLQTSTPIGAMGTPAPKTAFSFNTSDTQAQPSAAQEQVVPASVPTSPTTSPTVTVLASAPALAPQVATSYTPSSTTHIAQGAPHPPSRMHNSPTQNLPVPHCPPHNAHSPPRTSSSPASVNDSRGPRTTEPSTKSMMEVERKLAHRKTSKFPENPRGFPEPQ

SEQ ID NO: 65190 - protein, 190 aa, Homo sapiens
MSSSALTCGSTLEKSGDTWEMKALDSSRLVPWPPRGLGSSTQHPNKPHCALASCQGPGVLPGAASALPELTFQGDVCQSETCQRYLQAAISLDIAVSQINLLGRPSSPPALLIQQGSCEQVIHNSTPQFLGMEDGDNERTTGWLWRLCEDIDAEPSSTGCSRSNQLTFTEGCFVRSLSTVYSNTHIHTHL

SEQ ID NO: 65191 - protein, 596 aa, Homo sapiens
MGFIIHIQQVKKQRKKLDQGLILKKEKYRKEKKCASLSFEVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 65192 - protein, 652 aa, Homo sapiens
MTSASPEDQNAPVGCPKGARRRRPISVIGGVSLYGTNQTEELDNLLTQPASRPPMPAHQVPPYKAVSARFRPFTFSQSTPIGLDRVGRRRQMRASNVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 65193 - protein, 1277 aa, Homo sapiens
MTQAAVRPWAPCLENMTTAPNGLGPGPAAPCAGSDLKDAKMVTSLACGNGVCGCSPGGDTDTQEAKLSPAKLVRLFSTSRKRTGAHPERPHSMVLVGNSSTWNTLASFRKMGSFKKLKSSVLKGIQSREGSNACSKGEASEHGLGKSIPNGAVPGAQASRGSPLAPGPACGALRPAEWGTLDGSDLEDTDDAFQRSTHRSRSLRRAYGLGRICLLDAPQNHATPTIATGQVPAVCEILVRDPENNSMGYRRSKSTDNLAFLKKSSFKRKSTSNLADLRTAHDARVPQRTLSSSSTDSQKLGSGRTKRWRSPIRAKDFDRVFKLVSNVTEAAWRRESPRSGAPSPGEASLRLQAHSRLHDDYSRRVSRSTEQDSRRGGAVMHGTTATCTVAPGFGSATSKGPHLDADTAVFPLETKSSWAVESDSSCTCSSLPSPIVQDVLSKDSCDPNAGSQLTFDPEQPPTPLRPTTPKPQSPQSPQSPGAGSASCHSNHSALSANSEESEGRAEEPAQREPGPVSLQDPLEATHGDEGSKDLLVNIGVAAGPEEKEKEEVVPDGPWRRSSSQDEERTEAQRTPKRRWGSGRRPRPRPFSDYGQLASRSLSIPEDSVAADPQKEDRVDEDPQASMTSASPEDQNAPVGCPKGARRRRPISVIGGVSLYGTNQTEELDNLLTQPASRPPMPAHQVPPYKAVSARFRPFTFSQSTPIGLDRVGRRRQMRASNVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 65194 - protein, 1315 aa, Homo sapiens
  MOD_RES (1)..(1): Any amino acid
XPVATQEPDVQGRCECQDGIPGDEGLELRSADSAVPVAMTQAAVRPWAPCLENMTTAPNGLGPGPAAPCAGSDLKDAKMVTSLACGNGVCGCSPGGDTDTQEAKLSPAKLVRLFSTSRKRTGAHPERPHSMVLVGNSSTWNTLASFRKMGSFKKLKSSVLKGIQSREGSNACSKGEASEHGLGKSIPNGAVPGAQASRGSPLAPGPACGALRPAEWGTLDGSDLEDTDDAFQRSTHRSRSLRRAYGLGRICLLDAPQNHATPTIATGQVPAVCEILVRDPENNSMGYRRSKSTDNLAFLKKSSFKRKSTSNLADLRTAHDARVPQRTLSSSSTDSQKLGSGRTKRWRSPIRAKDFDRVFKLVSNVTEAAWRRESPRSGAPSPGEASLRLQAHSRLHDDYSRRVSRSTEQDSRRGGAVMHGTTATCTVAPGFGSATSKGPHLDADTAVFPLETKSSWAVESDSSCTCSSLPSPIVQDVLSKDSCDPNAGSQLTFDPEQPPTPLRPTTPKPQSPQSPQSPGAGSASCHSNHSALSANSEESEGRAEEPAQREPGPVSLQDPLEATHGDEGSKDLLVNIGVAAGPEEKEKEEVVPDGPWRRSSSQDEERTEAQRTPKRRWGSGRRPRPRPFSDYGQLASRSLSIPEDSVAADPQKEDRVDEDPQASMTSASPEDQNAPVGCPKGARRRRPISVIGGVSLYGTNQTEELDNLLTQPASRPPMPAHQVPPYKAVSARFRPFTFSQSTPIGLDRVGRRRQMRASNVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 65195 - protein, 616 aa, Homo sapiens
MPAHQVPPYKAVSARFRPFTFSQSTPIGLDRVGRRRQMRASNVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKVRLQQVPCGPTAPGPAPHPPAPHHYAHKRPPAAGLWPGGTQEEVLALLAHLQQAHPLPEMKTGGCASMELGVKRRN

SEQ ID NO: 65196 - protein, 569 aa, Homo sapiens
MDAGSSRSLENAVNRIYHDQLVPKINTSKKMSTLAHPPNILEMSQEIKKNCGGKQVEITLERTKMTKGIKEKQSNDLEKAAFKRKAEGEEKPTRKKQAKITELDNQLITMPLPHIPLKNIMDVEMKLVYIDEMGVRYEFVESFMSTGSQPTCQAAEIVDPLSVHNFSFLPQIDKWLQVALKDASSCYRQKKYALAAGQFRTALELCSKGAVLGEPFDAPAEDIASVASFIETKLVTCYLRMRKPDLALNHAHRSIVLNPAYFRNHLRQATVFRCLERYSEAARSAMIADYMFWLGGGREESISKLIKLYWQAMIEEAITRAESFSVMYTPFATKIRADKIEKVKDAFTKTHPAYAEYMYTDLQALHMLPQTVDWSSFPPQQYLLTLGFKNKDDGKFLEKISSRKLPIFTEHKTPFGLTREDTVRQMETMGKRILPILDFIRSTQLNGSFPASSGVMEKLQYASLLSQLQRVKEQSQVINQAMAELATIPYLQDISQQEAELLQSLMADAMDTLEGRRNNNERVWNMIQKVGQIEDFLYQLEDSFLKTKKLRTARRQKTKMKRLQTVQQR

SEQ ID NO: 65197 - protein, 361 aa, Homo sapiens
MATLARLQARSSTVGNQYYFRNSVVDPFRKKENDAAVKIQSWFRGCQVRAYIRHLNRIVTIIQKWWRSFLGRKQYQLTVQVAYYTMMMNLYNAMAVRIQRRWRGYRVRKYLFNYYYLKEYLKVVSETNDAIRKALEEFAEMKEREEKKANLEREEKKRDYQARKMHYLLSTKQIPGIYNSPFRKEPDPWELQLQKAKPLTHRRPKVKQKDSTSLTDWLACTSARSFPRSEILPPINRKQCQGPFRDITEVLEQRYRPLEPTLRVAEPIDELKLAREELRREEWLQNVNDNMFLPFSSYHKNEKYIPSMHLSSKYGPISYKEQFRSENPKKWICDKDFQTVLPSFELFSKYGKLYSKAGQIV

SEQ ID NO: 65198 - protein, 538 aa, Homo sapiens
MAENLKRLVSNETLRTLQEKLDFWLKEYNTNTCDQNLNHCLELIEQVAKVQGQLFGILTAAAQEGGRNDGVETIKSRLLPWLEASFTAASLGKSVDSKVPSLQDTFDRERHKDPSPRDRDMQQLDSNLNSTRSQCNQVQDDLVETEKNLEESKNRSAISLLAAEEEINQLKKQLKSLQAQEDARHRNTDQRSSENRRSEPWSLEERKREQWNSLKQNADQQDTEAMSDYKKQLRNLKEEIAVLSAEKSALQGRSSRSRSPSPAPRSRSCSRSRSASPSTAVKVRRPSPNRSKLSNVARKAALLSRFSDSYSQARLDAQCLLRRCIDKAETVQRIIYIATVEAFHVAKMAFRHFKIHVRKSLTPSYVGSNDFENAVLDYVICHLDLYDSQSSVNDVIRAMNVNPKISFPPVVDFCLLSDFIQEICCIAFAMQALEPPLDIAYGADGEVFNDCKYRRSYDSDFTAPLVLYHVWPALMENDCVIMKGEAVTRRGAFWNSVRSVSRCRSRSLSPICPRSQIGLNTMSRSRSPSPIRCGLPRF

SEQ ID NO: 65199 - protein, 167 aa, Homo sapiens
MIITTWIVYILARKGVGLPFLPITSSDIDVVESEAVSVLHHWLKKTEEEASRGIKEKLSINHPSQGVREKMSTDSPPTHGQDIHVTRDVVKHHLSKSDLLANQSQEVLEERTRIQFIRWSHTRIFQVPSEMTEDIMRDRIEQVRRSISRLTDVSAQDFSMRPSSSDC

SEQ ID NO: 65200 - protein, 167 aa, Homo sapiens; identical to SEQ ID NO: 65199

SEQ ID NO: 65201 - protein, 520 aa, Homo sapiens
MGKPSSMDTKFKDDLFRKYVQFHESKVDTTTSRQRPGSDECLRVAASTLLSLHKVDPFYRFRLIQFYEVVESSLRSLSSSSLRALHGAFSMLETVGINLFLYPWKKEFRSIKTYTGPFVYYVKSTLLEEDIRAILSCMGYTPELGTAYKLRELVETLQVKMVSFELFLAKVECEQMLEIHSQVKDKGYSELDIVSERKSSAEDVRGCSDALRRRAEGREHLTASMSRVALQKSASERAAKDYYKPRVTKPSRSVDAYDSYWESRKPPLKASLSLRKEPVATDVGDDLKDEIIRPSPSLLTMASSPHGSPDVLPPASPSNGPALLRGTYFSTQDDVDLYTDSEPRATYRRQDALRPDVWLLRNDAHSLYHKRSPPAKESALSKCQSCGLSCSSSLCQRCDSLLTCPPASKPSAFPSKASTHDSLAHGASLREKYPGQTQGLDRLPHLHSKSKPSTTPTSRCGFCNRPGATNTCTQCSKVSCDACLSAYHYDPCYKKSELHKFMPNNQLNYKSTQLSHLVYR

SEQ ID NO: 65202 - protein, 520 aa, Homo sapiens; identical to SEQ ID NO: 65201

SEQ ID NO: 65203 - protein, 383 aa, Homo sapiens [sequence omitted]

SEQ ID NO: 65204 - protein, 802 aa, Homo sapiens
MLGARAWLGRVLLLPRAGAGLAASRRCPGVWPRTWPHRSPSRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDKLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 65205 - protein, 786 aa, Homo sapiens
MLGARAWLGRVLLLPRAGAGLAASRRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDKLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 65206 - protein, 742 aa, Homo sapiens
MPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDKLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 65207 - protein, 75 aa, Homo sapiens
GQGHQGPGQCVHSVYIPNKVLILADGDPSSFLSRQLPFLSTLRRLEDQATAYVCENQACSVPITDPCELRKLLHP

SEQ ID NO: 65208 - protein, 43 aa, Homo sapiens
MLGARAWLGRVLLLPRAGAGLAASRRSACSPTSRLNSLRSLIP

SEQ ID NO: 65209 - protein, 305 aa, Homo sapiens
MAAAGQEKGYLTQTAAALDKSPSLSPQLAAPIRGRPKKCLVYPHAPKSSRLSRSVLRWLQGLDLSFFPRNINRDFSNGFLIAEIFCIYYPWELELSSFENGTSLKVKLDNWAQLEKFLARKKFKLPKELIHGTIHCKAGVPEILIEEVYTLLTHREIKSIQDDFVNFTDYSYQMRLPLVSRSTVSKSIKDNIRLSELLSNPNMLTNELKAEFLILLHMLQRKLGRKLNPEWFDVKPTVGEVTLNHLPAQASGRRYNLKVKRGRVVPVLPNIGSGGSSHREIHVKQAGQHSYYSAMKPIRNMDKKP

SEQ ID NO: 65210 - protein, 893 aa, Homo sapiens
MSSKKNRKRLNQSAENGSSLPSAASSCAEARAPSAGSDFAATSGTLTVTNLLEKVDDKIPKTFQNSLIHLGLNTMKSANICIGRPVLLTSLNGKQEVYTAWPMAGFPGGKVGLSEMAQKNVGVRPGDAIQVQPLVGAVLQAEEMDVALSDKDMEINEEELTGCILRKLDGKIVLPGNFLYCTFYGRPYKLQVLRVKGADGMILGGPQSDSDTDAQRMAFEQSSMETSSLELSLQLSQLDLEDTQIPTSRSTPYKPIDDRITNKASDVLLDVTQSPGDGSGLMLEEVTGLKCNFESAREGNEQLTEEERLLKFSIGAKCNTDTFYFISSTTRVNFTEIDKNSKEQDNQFKVTYDMIGGLSSQLKAIREIIELPLKQPELFKSYGIPAPRGVLLYGPPGTGKTMIARAVANEVGAYVSVINGPEIISKFYGETEAKLRQIFAEATLRHPSIIFIDELDALCPKREGAQNEVEKRVVASLLTLMDGIGSEVSEGQVLVLGATNRPHALDAALRRPGRFDKEIEIGVPNAQDRLDILQKLLRRVPHLLTEAELLQLANSAHGYVGADLKVLCNEAGLCALRRILKKQPNLPDVKVAGLVKITLKDFLQAMNDIRPSAMREIAIDVPNVSWSDIGGLESIKLKLEQAVEWPLKHPESFIRMGIQPPKGVLLYGPPGCSKTMIAKALANESGLNFLAIKGPELMNKYVGESERAVRETFRKARAVAPSIIFFDELDALAVERGSSLGAGNVADRVLAQLLTEMDGIEQLKDVTILAATNRPDRIDKALMRPGRIDRIIYVPLPDAATRREIFKLQFHSMPVSNEVDLDELILQTDAYSGAEIVAVCREAALLALEEDIQANLIMKRHFTQALSTVTPRIPESLRRFYEDYQEKSGLHTL

SEQ ID NO: 65211 - protein, 249 aa, Homo sapiens
MQLDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRDERDLEKDDELELKRSLLCRDSAYDS

SEQ ID NO: 65212 - protein, 472 aa, Homo sapiens
MPKVKALQCALALEISSVTCPGVVLKDKEDIYLSICVFGQYKKTQCVPATFPLVFNARMVFEKVFPDAVDPGDVVTQLEYDTAVFELIQLVPPVGETLSTYDENTRDFMFPGPNQMSGHHDSNRQVTMRRISGLRGNAPRLEFSTTSVITECLISSRKCHTQDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRDERDLEKDDELELKRSLLCRDSAYDSDPEYSSCQQPRGTFHLDDGEYWSNRAASYKGKSHRPIFENSMDKMYRNLYKKACSSASHTQESF

SEQ ID NO: 65213 - protein, 488 aa, Homo sapiens
MPKVKALQCALALEISSVTCPGVVLKDKEDIYLSICVFGQYKKTQCVPATFPLVFNARMVFEKVFPDAVDPGDVVTQLEYDTAVFELIQLVPPVGETLSTYDENTRDFMFPGPNQMSGHHDSNRQVTMRRISGLRGNAPRLEFSTTSVITECLISSRKCHTQDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRVKNVLKSHQAHQRHLYDERDLEKDDELELKRSLLCRDSAYDSDPEYSSCQQPRGTFHLDDGEYWSNRAASYKGKSHRPIFENSMDKMYRNLYKKACSSASHTQESF

SEQ ID NO: 65214 - protein, 416 aa, Homo sapiens
MVFEKVFPDAVDPGDVVTQLELGETLSTYDENTRDFMFPGPNQMSGHHDSNRQVTMRRISGLRGNAPRLEFSTTSVITECLISSRKCHTQDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRVKNVLKSHQAHQRHLYDERDLEKDDELELKRSLLCRDSAYDSDPEYSSCQQPRGTFHLDDGEYWSNRAASYKGKSHRPIFENSMDKMYRNLYKKACSSASHTQESF

SEQ ID NO: 65215 - protein, 458 aa, Homo sapiens
MDGSRRVRATSVLPRYGPPCLFKGHLSTKSNAFCTDSSSLRLSTLQLVKNHMAVHYNKILSAKAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSFSSVKGDNNHDMELSTLKIMEMSIEDCPLDV

SEQ ID NO: 65216 - protein, 567 aa, Homo sapiens
MDGSRRVRATSVLPRYGPPCLFKGHLSTKSNAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 65217 - protein, 599 aa, Homo sapiens
MDGSRRVRATSVLPRYGPPCLFKGHLSTKSNAFCTDSSSLRLSTLQLVKNHMAVHYNKILSAKAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 65218 - protein, 567 aa, Homo sapiens; identical to SEQ ID NO: 65216

SEQ ID NO: 65219 - protein, 105 aa, Homo sapiens
MAPAGMSGAQDNSCLYQEIAPSFQRLPCPRTSSRHFSEAMTCPCGWRPFKGGPGGLKGPVWPAKEENSCSHGRIQRVQRRRVPSASPLIQKINRRSVLFHPYCWS

SEQ ID NO: 65220 - protein, 545 aa, Homo sapiens
MSRKQNQKDSSGFIFDLQSNTVLAQGGAFENMKEKINAVRAIVPNKSNNEIILVLQHFDNCVDKTVQAFMEGSASEVLKEWTVTGKKKNKKKKNKPKPAAEPSNGIPDSSKSVSIQEEQSAPSSEKGGMNGYHVNGAINDTESVDSLSEGLETLSIDARELEDPESAMLDTLDRTGSMLQNGVSDFETKSLTMHSIHNSQQPRNAAKSLSRPTTETQFSNMGMEDVPLATSKKLSSNIEKSVKDLQRCTVSLARYRVVVKEEMDASIKKMKQAFAELESCLMDREVALLAEMDKVKAEAMEILLSRQKKAELLKKMTHVAVQMSEQQLVELRADIKHFVSERKYDEDLGRVARFTCDVETLKKSIDSFGQVSHPKNSYSTRSRCSSVTSVSLSSPSDASAASSSTCASPPSLTSANKKNFAPGETPAAIANSSGQPYQPLREVLPGNRRGGQGYRPQGQKSNDPMNQGRHDSMGRYRNSSWYSSGSRYQSAPSQAPGNTIERGQTHSAGTNGTGVSMEPSPPTPSFKKGLPQRKPRTSQTEAVNS

SEQ ID NO: 65221 - protein, 545 aa, Homo sapiens
VSKKKKKKDSSGFIFDLQSNTVLAQGGAFENMKEKINAVRAIVPNKSNNEIILVLQHFDNCVDKTVQAFMEGSASEVLKEWTVTGKKKNKKKKNKPKPAAEPSNGIPDSSKSVSIQEEQSAPSSEKGGMNGYHVNGAINDTESVDSLSEGLETLSIDARELEDPESAMLDTLDRTGSMLQNGVSDFETKSLTMHSIHNSQQPRNAAKSLSRPTTETQFSNMGMEDVPLATSKKLSSNIEKSVKDLQRCTVSLARYRVVVKEEMDASIKKMKQAFAELESCLMDREVALLAEMDKVKAEAMEILLSRQKKAELLKKMTHVAVQMSEQQLVELRADIKHFVSERKYDEDLGRVARFTCDVETLKKSIDSFGQVSHPKNSYSTRSRCSSVTSVSLSSPSDASAASSSTCASPPSLTSANKKNFAPGETPAAIANSSGQPYQPLREVLPGNRRGGQGYRPQGQKSNDPMNQGRHDSMGRYRNSSWYSSGSRYQSAPSQAPGNTIERGQTHSAGTNGTGVSMEPSPPTPSFKKGLPQRKPRTSQTEAVNS

SEQ ID NO: 65222 - protein, 8 aa, Homo sapiens
MSRKQNQK

SEQ ID NO: 65223 - protein, 8 aa, Homo sapiens
MSRKQNQK

SEQ ID NO: 65224 - protein, 67 aa, Homo sapiens
MSRKQNQKDSSGFIFDLQSNTVLAQGGAFENMKEKINAVRAIVPNKSNNEIILVLQHFDNCVDKTVQ

SEQ ID NO: 65225 - protein, 33 aa, Homo sapiens
MSRKQNQKDSSGFIFDLQSNTVLAQGGAFENMK

SEQ ID NO: 65226 - protein, 5 aa, Homo sapiens
MSRKQ

SEQ ID NO: 65227 - protein, 36 aa, Homo sapiens
MSRKQNQKDSSGFIFDLQSNTVLAQGGAFENMKEKV

SEQ ID NO: 65228 - protein, 66 aa, Homo sapiens
MSRKQNQKDSSGFIFDLQSNTVLAQGGAFENMKEKINAVRAIVPNKSNNEIILVLQHFDNCVDKTV

SEQ ID NO: 65229 - protein, 34 aa, Homo sapiens
MSRKQNQKDSSGFIFDLQSNTVLAQGGAFENMKE

SEQ ID NO: 65230 - protein, 98 aa, Homo sapiens
MSRKQNQKDSSGFIFDLQSNTVLAQGGAFENMKEKINAVRAIVPNKSNNEIILVLQHFDNCVDKTVQAFMEGSASEVLKEWTVTGKKKNKKKKNKPKP

SEQ ID NO: 65231 - protein, 74 aa, Homo sapiens
MSRKQNQKDSSGFIFDLQSNTVLAQGGAFENMKEKINAVRAIVPNKSNNEIILVLQHFDNCVDKTVQAFMEGSA

SEQ ID NO: 65232 - protein, 10 aa, Homo sapiens
MSRKQNQKDS

SEQ ID NO: 65233 - protein, 545 aa, Homo sapiens; identical to SEQ ID NO: 65220

SEQ ID NO: 65234 - protein, 545 aa, Homo sapiens; identical to SEQ ID NO: 65220

SEQ ID NO: 65235 - protein, 558 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 65236 - protein, 489 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 65237 - protein, 558 aa, Homo sapiens; identical to SEQ ID NO: 65235

SEQ ID NO: 65238 - protein, 566 aa, Homo sapiens
MAYSTRSKMAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 65239 - protein, 266 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAA

SEQ ID NO: 65240 - protein, 558 aa, Homo sapiens; identical to SEQ ID NO: 65235

SEQ ID NO: 65241 - protein, 588 aa, Homo sapiens
MDPFCHSSSETRLLSGTLLWIPRAYSTRSKMAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 65242 - protein, 558 aa, Homo sapiens; identical to SEQ ID NO: 65235

SEQ ID NO: 65243 - protein, 154 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLL

SEQ ID NO: 65244 - protein, 140 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEP

SEQ ID NO: 65245 - protein, 13 aa, Homo sapiens
MAELNTHVNVKEK

SEQ ID NO: 65246 - protein, 94 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAG

SEQ ID NO: 65247 - protein, 115 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDS

SEQ ID NO: 65248 - protein, 23 aa, Homo sapiens
MAELNTHVNVKEKIYAVRSVVPN

SEQ ID NO: 65249 - protein, 173 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTGPNIEKSVKDLQRCTVSLTRYRVMI

SEQ ID NO: 65250 - protein, 558 aa, Homo sapiens; identical to SEQ ID NO: 65235

SEQ ID NO: 65251 - protein, 188 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPS

SEQ ID NO: 65252 - protein, 302 aa, Homo sapiens
MEPGPDGPAASGPAAIREGWFRETCSLWPGQALSLQVEQLLHHRRSRYQDILVFRSKTYGNVLVLDGVIQCTERDEFSYQEMIANLPLCSHPNPRKVLIIGGGDGGVLREVVKHPSVESVVQCEIDEDVIQVSKKFLPGMAIGYSSSKLTLHVGDGFEFMKQNQDAFDVIITDSSDPMGPAESLFKESYYQLMKTALKEDGVLCCQGECQWLHLDLIKEMRQFCQSLFPVVAYAYCTIPTYPSGQIGFMLCSKNPSTNFQEPVQPLTQQQVAQMQLKYYNSDVHRAAFVLPEFARKALNDVS

SEQ ID NO: 65253 - protein, 199 aa, Homo sapiens
EEPPPPTVQVQGPGPQREEKQKTKMAKFVIRPATAADCSDILRLIKELAKYEYMEEQVILTEKDLLEDGFGEHPFYHCLVAEVPKEHWTPEGNPSPFPEARETKCYYFTYDPWIGKLLYLEDFFVMSDYRGLWHRIRNSEESKPGCNEVSLAACTSWAEWNEPSINFYKRRGASDLSSEEGWRLFKIDKEYLLKMATEE

SEQ ID NO: 65254 - protein, 150 aa, Homo sapiens
MAKFVIRPATAADCSDILRLIKELAKYEYMEEQVILTEKGNSTVAGRGTSVRCLSPSPRPLPPLLPLLADLLEDGFGEHPFYHCLVAEVPKEHWTPEGNPSPFPEARETKCYVRSSVGCVEPLTTQAEVTENLDRKNSQQVFKLLRKKKN

SEQ ID NO: 65255 - protein, 120 aa, Homo sapiens
MAKFVIRPATAADCSDILRLIKELAKYEYMEEQVILTEKDLLEDGFGEHPFYHCLVAEVPKEHWTPEGNPSPFPEARETKCYVRSSVGCVEPLTTQAEVTENLDRKNSQQVFKLLRKKKN

SEQ ID NO: 65256 - protein, 143 aa, Homo sapiens
MAKFVIRPATAADCSDILRLIKELAKYEYMEEQVILTEKGHSIVGFAMYYFTYDPWIGKLLYLEDFFVMSDYRGFGIGSEILKNLSQVAMRCRCSSMHFLVAEWNEPSINFYKRRGASDLSSEEGWRLFKIDKEYLLKMATEE

SEQ ID NO: 65257 - protein, 171 aa, Homo sapiens
MAKFVIRPATAADCSDILRLIKELAKYEYMEEQVILTEKDLLEDGFGEHPFYHCLVAEVPKEHWTPEGHSIVGFAMYYFTYDPWIGKLLYLEDFFVMSDYRGFGIGSEILKNLSQVAMRCRCSSMHFLVAEWNEPSINFYKRRGASDLSSEEGWRLFKIDKEYLLKMATEE

SEQ ID NO: 65258 - protein, 170 aa, Homo sapiens
MASVRIREAKEGDCGDILRLIRELAEFEKLSDQVKISEEALRADGFGDNPFYHCLVAEILPAPGKLLGPCVVGYGIYYFIYSTWKGRTIYLEDIYVMPEYRGQGIGSKIIKKVAEVALDKGCSQFRLAVLDWNQRAMDLYKALGAQDLTEAEGWHFFCFQGEATRKLAGK

SEQ ID NO: 65259 - protein, 249 aa, Homo sapiens
MPGQRIASLAYSLLPYGAGIPAPLTRPRLPRRPPRLPPPRSLRLFRIQVRRPFKGSSCRLRGPGTLVPDSGDPDGFRADPRGQGGRLWRYPEADSGEDCRPELAEFEKLSDQVKISEEALRADGFGDNPFYHCLVAEILPAPGKLLGPCVVGYGIYYFIYSTWKGRTIYLEDIYVMPEYRGQGIGSKIIKKVAEVALDKGCSQFRLAVLDWNQRAMDLYKALGAQDLTEAEGWHFFCFQGEATRKLAGK

SEQ ID NO: 65260 - protein, 313 aa, Homo sapiens
MAAARHSTLDFMLGAKADGETILKGLQSIFQEQGMAESVHTWQDHGYLATYTNKNGRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEIDQMVIDGCKKYMRKTCGDVLDNLKGDCYQVLIEDCIPVLKRYAKEGREFDYVINDLTAVPISTSPEEDSTWEFLRLILDLSMKVLKQDGKYFTQGNCVNLTEALSLYEEQLGRLYCPVEFSKEIVCVPSYLELWVFYTVWKKAKP

SEQ ID NO: 65261 - protein, 366 aa, Homo sapiens
MAAARHSTLDFMLGAKADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEIDQMVIDGCKKYMRKTCGDVLDNLKGDCYQVLIEDCIPVLKRYAKEGREFDYVINDLTAVPISTSPEEDSTWEFLRLILDLSMKVLKQDGKYFTQGNCVNLTEALSLYEEQLGRLYCPVEFSKEIVCVPSYLELWVFYTVWKKAKP

SEQ ID NO: 65262 - protein, 275 aa, Homo sapiens
MKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEIDQMVIDGCKKYMRKTCGDVLDNLKGDCYQVLIEDCIPVLKRYAKEGREFDYVINDLTAVPISTSPEEDSTWEFLRLILDLSMKVLKQDGKYFTQGNCVNLTEALSLYEEQLGRLYCPVEFSKEIVCVPSYLELFLLQFWRVRSSKCALEG

SEQ ID NO: 65263 - protein, 311 aa, Homo sapiens
  MOD_RES (1)..(1): Any amino acid
XGGRAEAALLLAPRSVPAAARGLQGQSRVPAGRAALPGPGRPPALPRGLAAFALPLGESPGCRARADPPWDEGCRDCGGARRDPRGEPGLGACAERGCPRDLFLFLQAADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMV

SEQ ID NO: 65264 - protein, 1266 aa, Homo sapiens
REATPPLRGLPAPPRHAPFPAGRFEPPRTKQGGRGSHTPWVYVINDLGIEENLKNDGKPKCQTGGKSKRTIQGTHKTTKQQSTAVDCKITSSTTGDKHFDKSPTKTRHPRKIDLRARYWAFLFDNLRRAVDEIYVTCESDQSVVECKEVLMMLDNYVRDFKALIDWIQLQEKLEKTDAQSRPTSLAWEVKKMSPGRHVIPSPSTDRINVTSNARRSLNFGGSTGTVPAPRLAPTGVSWADKVKAHHTGSTASSEITPAQSCPPMTVQKASRKNERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNVSAANLSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQRQEKEKAREDAARERARDREERLAALTAAQQEAMEELQKKIQLKHDESIRRHMEQIEQRKEKAAELSSGRHANTDYAPKLTPYERKKQCSLCNVLISSEVYLFSHVKGRKHQQAVRENTSIQGRELSDEEVEHLSLKKYIIDIVVESTAPAEALKDGEERQKNKKKAKKIKARMNFRAKEYESLMETKNSGSDSPYKAKLQRLAKDLLKQVQVQDSGSWANNKVSALDRTLGEITRILEKENVADQIAFQAAGGLTALEHILQAVVPATNVNTVLRIPPKSLCNAINVYNLTCNNCSENCSDVLFSNKITFLMDLLIHQLTVYVPDENNTILGRNTNKQVFEGLTTGLLKVSAVVLGCLIANRPDGNCQPATPKIPTQEMKNKPSQGDPFNNRVQDLISYVVNMGLIDKLCACFLSVQGPVDENPKMAIFLQHAAGLLHAMCTLCFAVTGRSYSIFDNNRQDPTGLTAALQATDLAGVLHMLYCVLFHGTILDPSTASPKENYTQNTIQVAIQSLRFFNSFAALHLPAFQVPSIGLYRC

SEQ ID NO: 65265 - protein, 1400 aa, Homo sapiens
MMASFQRSNSHDKVRRIVAEEGRTARNLIAWSVPLESKDDDGKPKCQTGGKSKRTIQGTHKTTKQSTAVDCKITSSTTGDKHFDKSPTKTRHPRKIDLRARYWAFLFDNLRRAVDEIYVTCESDQSVVECKEVLMMLDNYVRDFKALIDWIQLQEKLEKTDAQSRPTSLAWEVKKMSPGRHVIPSPSTDRINVTSNARRSLNFGGSTGTVPAPRLAPTGVSWADKVKAHHTGSTASSEITPAQSCPPMTVQKASRKNERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQRQEKEKAREDAARERARDREERLAALTAAQQEAMEELQKKIQLKHDESIRRHMEQIEQRKEKAAELSSGRHANTDYAPKLTPYERKKQCSLCNVLISSEVYLFSHVKGRKHQQAVRENTSIQGRELSDEEVEHLSLKKYIIDIVVESTAPAEALKDGEERQKNKKKAKKIKARMNFRAKEYESLMETKNSGSDSPYKAKLQRLAKDLLKQVQVQDSGSWANNKVSALDRTLGEITRILEKENVADQIAFQAAGGLTALEHILQAVVPATNVNTVLRIPPKSLCNAINVYNLTCNNCSENCSDVLFSNKITFLMDLLIHQLTVYVPDENNTILGRNTNKQVFEGLTTGLLKVSAVVLGCLIANRPDGNCQPATPKIPTQEMKNKPSQGDPFNNRVQDLISYVVNMGLIDKLCACFLSVQGPVDENPKMAIFLQHAAGLLHAMCTLCFAVTGRSYSIFDNNRQDPTGLTAALQATDLAGVLHMLYCVLFHGTILDPSTASPKENYTQNTIQVAIQSLRFFNSFAALHLPAFQSIVGAEGLSLAFRHMASSLLGHCSQVSCESLLHEVIVCVGYFTVNHPDNQVIVQSGRHPTVLQKLCQLPFQYFSDPRLIKVLFPSLIAACYNNHQNKIILEQEMSCVLLATFIQDLAQTPGQAENQPYQPKGKCLGSQDYLELANRFPQQAWEEARQFFLKKEKK

SEQ ID NO: 65266 - protein, 1154 aa, Homo sapiens
MKTKYIFCNITERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQRQEKEKAREDAARERARDREERLAALTAAQQEAMEELQKKIQLKHDESIRRHMEQIEQRKEKAAELSSGRHANTDYAPKLTPYERKKQCSLCNVLISSEVYLFSHVKGRKHQQAVRENTSIQGRELSDEEVEHLSLKKYIIDIVVESTAPAEALKDGEERQKNKKKAKKIKARMNFRAKEYESLMETKNSGSDSPYKAKLQRLAKDLLKQVQVQDSGSWANNKVSALDRTLGEITRILEKENVADQIAFQAAGGLTALEHILQAVVPATNVNTVLRIPPKSLCNAINVYNLTCNNCSENCSDVLFSNKITFLMDLLIHQLTVYVPDENNTILGRNTNKQVFEGLTTGLLKVSAVVLGCLIANRPDGNCQPATPKIPTQEMKNKPSQGDPFNNRVQDLISYVVNMGLIDKLCACFLSVQGPVDENPKMAIFLQHAAGLLHAMCTLCFAVTGRSYSIFDNNRQDPTGLTAALQATDLAGVLHMLYCVLFHGTILDPSTASPKENYTQNTIQVAIQSLRFFNSFAALHLPAFQSIVGAEGLSLAFRHMASSLLGHCSQVSCESLLHEVIVCVGYFTVNHPDNQVIVQSGRHPTVLQKLCQLPFQYFSDPRLIKVLFPSLIAACYNNHQNKIILEQEMSCVLLATFIQDLAQTPGQAENQPYQPKGKCLGSQDYLELANRFPQQAWEEARQFFLKKEKK

SEQ ID NO: 65267 - protein, 1400 aa, Homo sapiens; identical to SEQ ID NO: 65265

SEQ ID NO: 65268 - protein, 410 aa, Homo sapiens
MHRKHLQEIPDLSSNVATSFTWGWDSSKTSELLSGMGVSALEKEEPDSENIPQELLSNLGHPESPPRKRLKSKGSDKDFVIVRRPKLNRENFPGVSWDSLPDELLLGIFSCLCLPELLKVSGVCKRWYRLASDESLWQTLDLTGKNLHPDVTGRLLSQGVIAFRCPRSFMDQPLAEHFSPFRVQHMDLSNSVIEVSTLHGILSQCSKLQNLSLEGLRLSDPIVNTLAKNSNLVRLNLSGCSGFSEFALQTLLSSCSRLDELNLSWCFDFTEKHVQVAVAHVSETITQLNLSGYRKNLQKSDLSTLVRRCPNLVHLDLSDSVMLKNDCFQEFFQLNYLQHLSLSRCYDIIPETLLLVTRAGVRIRLDSDIGCPQTYRTSKLKSSHKLFCQHVRVICIFVCDFYFYRLVLKQ

SEQ ID NO: 65269 - protein, 424 aa, Homo sapiens
MHRKHLQEIPDLSSNVATSFTWGWDSSKTSELLSGMGVSALEKEEPDSENIPQELLSNLGHPESPPRKRLKSKGSDKDFVIVRRPKLNRENFPGVSWDSLPDELLLGIFSCLCLPELLKVSGVCKRWYRLASDESLWQTLDLTGKNLHPDVTGRLLSQGVIAFRCPRSFMDQPLAEHFSPFRVQHMDLSNSVIEVSTLHGILSQCSKLQNLSLEGLRLSDPIVNTLAKNSNLVRLNLSGCSGFSEFALQTLLSSCSRLDELNLSWCFDFTEKHVQVAVAHVSETITQLNLSGYRKNLQKSDLSTLVRRCPNLVHLDLSDSVMLKNDCFQEFFQLNYLQHLSLSRCYDIIPETLLELGEIPTLKTLQVFGIVPDGTLQLLKEALPHLQINCSHFTTIARPTIGNKKNQEIWGIKCRLTLQKPSCL

SEQ ID NO: 65270 - protein, 390 aa, Homo sapiens
MHRKHLQEKEEPDSENIPQELLSNLGHPESPPRKRLKSKGSDKDFVIVRRPKLNRENFPGVSWDSLPDELLLGIFSCLCLPELLKVSGVCKRWYRLASDESLWQTLDLTGKNLHPDVTGRLLSQGVIAFRCPRSFMDQPLAEHFSPFRVQHMDLSNSVIEVSTLHGILSQCSKLQNLSLEGLRLSDPIVNTLAKNSNLVRLNLSGCSGFSEFALQTLLSSCSRLDELNLSWCFDFTEKHVQVAVAHVSETITQLNLSGYRKNLQKSDLSTLVRRCPNLVHLDLSDSVMLKNDCFQEFFQLNYLQHLSLSRCYDIIPETLLELGEIPTLKTLQVFGIVPDGTLQLLKEALPHLQINCSHFTTIARPTIGNKKNQEIWGIKCRLTLQKPSCL

SEQ ID NO: 65271 - protein, 210 aa, Homo sapiens
MDQPLAEHFSTLAKNSNLVRLNLSGCSGFSEFALQTLLSSCSRLDELNLSWCFDFTEKHVQVAVAHVSETITQLNLSGYRKNLQKSDLSTLVRRCPNLVHLDLSDSVMLKNDCFQEFFQLNYLQHLSLSRCYDIIPETLLELGEIPTLKTLQVFGIVPDGTLQLLKEALPHLQINCSHFTTIARPTIGNKKNQEIWGIKCRLTLQKPSCL

SEQ ID NO: 65272 - protein, 453 aa, Homo sapiens
MALVRALVCCLLTAWHCRSGLGLPVAPAGGRNPPPAIGQFWHVTDLHLDPTYHITDDHTKVCASSKGANASNPGPFGDVLCDSPYQLILSAFDFIKNSGQEASFMIWTGDSPPHVPVPELSTDTVINVITNMTTTIQSLFPNLQVFPALGNHDYWPQDQLPVVTSKVYNAVANLWKPWLDEEAISTLRKGGFYSQKVTTNPNLRIISLNTNLYYGPNIMTLNKTDPANQFEWLESTLNNSQQNKEKVYIIAHVPVGYLPSSQNITAMREYYNEKLIDIFQKYSDVIAGQFYGHTHRDSIMVLSDKKGSPVNSLFVAPAVTPVKSVLEKQTNNPGIRLFQYDPRDYKLLDMLQYYLNLTEANLKGESIWKLEYILTQTYDIEDLQPESLYGLAKQFTILDSKQFIKYYNYFFVSYDSSVTCDKTCKAFQICAIMNLDNISYADCLKQLYIKHNY

SEQ ID NO: 65273 - protein, 322 aa, Homo sapiens
MTTTIQSLFPNLQVFPALGNHDYWPQDQLPVVTSKVYNAVANLWKPWLDEEAISTLRKGGFYSQKVTTNPNLRIISLNTNLYYGPNIMTLNKTDPANQFEWLESTLNNSQQNKEKVYIIAHVPVGYLPSSQNITAMREYYNEKLIDIFQKYSDVIAGQFYGHTHRDSIMVLSDKKGSPVNSLFVAPAVTPVKSVLEKQTNNPGIRLFQYDPRDYKLLDMLQYYLNLTEANLKGESIWKLEYILTQTYDIEDLQPESLYGLAKQFTILDSKQFIKYYNYFFVSYDSSVTCDKTCKAFQICAIMNLDNISYADCLKQLYIKHNY

SEQ ID NO: 65274 - protein, 241 aa, Homo sapiens
MKEVVYWSPKKVADWLLENAMPEYCEPLEHFTGQDLINLTQEDFKKPPLCRVSSDNGQRLLDMIETLKMEHHLEAHKNGHANGHLNIGVDIPTPDGSFSIKIKPNGMPNGYRKEMIKIPMPELERSQYPMEWGKTFLAFLYALSCFVLTTVMISVVHERVPPKEVQPPLPDTFFDHFNRVQWAFSICEINGMILVGLWLIQWLLLKYKDVGNESRVVMIFLSIVHPVLLLGSIAGFLSLSL

SEQ ID NO: 65275 - protein, 413 aa, Homo sapiens
MKEVVYWSPKKVADWLLENAMPEYCEPLEHFTGQDLINLTQEDFKKPPLCRVSSDNGQRLLDMIETLKMEHHLEAHKNGHANGHLNIGVDIPTPDGSFSIKIKPNGMPNGYRKEMIKIPMPELERSQYPMEWGKTFLAFLYALSCFVLTTVMISVVHERVPPKEVQPPLPDTFFDHFNRVQWAFSICEINGMILVGLWLIQWLLLKYKSIISRRFFCIVGTLYLYRCITMYVTTLPVPGMHFNCSPKLFGDWEAQLRRIMKLIAGGGLSITGSHNMCGDYLYSGHTVMLTLTYLFIKEYSPRRLWWYHWICWLLSVVGIFCILLAHDHYTVDVVVAYYITTRLFWWYHTMANQQVLKEASQMNLLARVWWYRPFQYFEKNVQGIVPRSYHWPFPWPVVHLSRQVKYSRLVNDT

SEQ ID NO: 65276 - protein, 213 aa, Homo sapiens
TYMYISNKSIISRRFFCIVGTLYLYRCITMYVTTLPVPGMHFNCSPKLFGDWEAQLRRIMKLIAGGGLSITGSHNMCGDYLYSGHTVMLTLTYLFIKEYSPRRLWWYHWICWLLSVVGIFCILLAHDHYTVDVVVAYYITTRLFWWYHTMANQQVLKEASQMNLLARVWWYRPFQYFEKNVQGIVPRSYHWPFPWPVVHLSRQVKYSRLVNDT

SEQ ID NO: 65277 - protein, 244 aa, Homo sapiens
MGGRGGGGRSRQLPGRFRAPAARWPGGRWLPGAPRTVTWSIISRRFFCIVGTLYLYRCITMYVTTLPVPGMHFNCSPKLFGDWEAQLRRIMKLIAGGGLSITGSHNMCGDYLYSGHTVMLTLTYLFIKEYSPRRLWWYHWICWLLSVVGIFCILLAHDHYTVDVVVAYYITTRLFWWYHTMANQQVLKEASQMNLLARVWWYRPFQYFEKNVQGIVPRSYHWPFPWPVVHLSRQVKYSRLVNDT

SEQ ID NO: 65278 - protein, 365 aa, Homo sapiens
MDIIETAKLEEHLENQPSDPTNTYARPAEPVEEENKNGNGKPKSLSSGLRKGTKKYPDYIQIAMPTESRNKFPLEWWKTGIAFIYAVFNLVLTTVMITVVHERVPPKELSPPLPDKFFDYIDRVKWAFSVSEINGIILVGLWITQWLFLRYKSIVGRRFCFIIGTLYLYRCITMYVTTLPVPGMHFQCAPKLNGDSQAKVQRILRLISGGGLSITGSHILCGDFLFSGHTVTLTLTYLFIKEYSPRHFWWYHLICWLLSAAGIICILVAHEHYTIDVIIAYYITTRLFWWYHSMANEKNLKVSSQTNFLSRAWWFPIFYFFEKNVQGSIPCCFSWPLSWPPGCFKSSCKKYSRVQKIGEDNEKST

SEQ ID NO: 65279 - protein, 365 aa, Homo sapiens; identical to SEQ ID NO: 65278

SEQ ID NO: 65280 - protein, 365 aa, Homo sapiens; identical to SEQ ID NO: 65278

SEQ ID NO: 65281 - protein, 44 aa, Homo sapiens
MDIIETAKLEEHLENQPSDPTNTYARPAEPVEEENKNGNGKPKS

SEQ ID NO: 65282 - protein, 34 aa, Homo sapiens
MDIIETAKLEEHLENQPSDPTNTYARPAEPVEEE

SEQ ID NO: 65283 - protein, 441 aa, Homo sapiens
MSLRQRLAQLVGRLQDPQKVARFQRLCGVEAPPRRSADRREDEKAEAPLAGDPRLRGRQPGAPGGPQPPGSDRNQCPAKPDGGGAPNGVRNGLAAELGPASPRRAGALRRNSLTGEEGQLARVSNWPLYCLFCFGTELGNELFYILFFPFWIWNLDPLVGRRLVVIWVLVMYLGQCTKDIIRWPRPASPPVVKLEVFYNSEYSMPSTHAMSGTAIPISMVLLTYGRWQYPLIYGLILIPCWCSLVCLSRIYMGMHSILDIIAGFLYTILILAVFYPFVDLIDNFNQTHKYAPFIIIGLHLALGIFSFTLDTWSTSRGDTAEILGSGAGIACGSHVTYNMGLVLDPSLDTLPLAGPPITVTLFGKAILRILIGMVFVLIIRDVMKKITIPLACKIFNIPCDDIRKARQHMEVELPYRYITYGMVGFSITFFVPYIFFFIGIS

SEQ ID NO: 65284 - protein, 399 aa, Homo sapiens
MAELLRSLQDSQLVARFQRRCGLFPAPDEGPRENGADPTERAARVPGVEHLPAANGKGGEAPANGLRRAAAPEAYVQKYVVKNYFYYYLFQFSAALGQEVFYITFLPFTHWNIDPYLSRRLIIIWVLVMYIGQVAKDVLKWPRPSSPPVVKLEKRLIAEYGMPSTHAMAATAIAFTLLISTMDRYQYPFVLGLVMAVVFSTLVCLSRLYTGMHTVLDVLGGVLITALLIVLTYPAWTFIDCLDSASPLFPVCVIVVPFFLCYNYPVSDYYSPTRADTTTILAAGAGVTIGFWINHFFQLVSKPAESLPVIQNIPPLTTYMLVLGLTKFAVGIVLILLVRQLVQNLSLQVLYSWFKVVTRNKEARRRLEIEVPYKFVTYTSVGICATTFVPMLHRFLGLP

SEQ ID NO: 65285 - protein, 353 aa, Homo sapiens
MGSLYSEYLNPNKVQEHYNYTKETLETQETTSRQVASAFIVILCCAIVVENLLVLIAVARNSKFHSAMYLFLGNLAASDLLAGVAFVANTLLSGSVTLRLTPVQWFAREGSAFITLSASVFSLLAIAIERHVAIAKVKLYGSDKSCRMLLLIGASWLISLVLGGLPILGWNCLGHLEACSTVLPLYAKHYVLCVVTIFSIILLAIVALYVRIYCVVRSSHADMAAPQTLALLKTVTIVLGVFIVCWLPAFSILLLDYACPVHSCPILYKAHYFFAVSTLNSLLNPVIYTWRSRDLRREVLRPLQCWRPGVGVQGRRRGGTPGHHLLPLRSSSSLERGMHMPTSPTFLEGNTVV

SEQ ID NO: 65286 - protein, 378 aa, Homo sapiens
MATALPPRLQPVRGNETLREHYQYVGKLAGRLKEASEGSTLTTVLFLVICSFIVLENLMVLIAIWKNNKFHNRMYFFIGNLALCDLLAGIAYKVNILMSGKKTFSLSPTVWFLREGSMFVALGASTCSLLAIAIERHLTMIKMRPYDANKRHRVFLLIGMCWLIAFTLGALPILGWNCLHNLPDCSTILPLYSKKYIAFCISIFTAILVTIVILYARIYFLVKSSSRKVANHNNSERSMALLRTVVIVVSVFIACWSPLFILFLIDVACRVQACPILFKAQWFIVLAVLNSAMNPVIYTLASKEMRRAFFRLVCNCLVRGRGARASPIQPALDPSRSKSSSSNNSSHSPKVKEDLPHTAPSSCIMDKNAALQNGIFCN

SEQ ID NO: 65287 - protein, 378 aa, Homo sapiens; identical to SEQ ID NO: 65286

SEQ ID NO: 65288 - protein, 384 aa, Homo sapiens
MNATGTPVAPESCQQLAAGGHSRLIVLHYNHSGRLAGRGGPEDGGLGALRGLSVAASCLVVLENLLVLAAITSHMRSRRWVYYCLVNITLSDLLTGAAYLANVLLSGARTFRLAPAQWFLREGLLFTALAASTFSLLFTAGERFATMVRPVAESGATKTSRVYGFIGLCWLLAALLGMLPLLGWNCLCAFDRCSSLLPLYSKRYILFCLVIFAGVLATIMGLYGAIFRLVQASGQKAPRPAARRKARRLLKTVLMILLAFLVCWGPLFGLLLADVFGSNLWAQEYLRGMDWILALAVLNSAVNPIIYSFRSREVCRAVLSFLCCGCLRLGMRGPGDCLARAVEAHSGASTTDSSLRPRDSFRGSRSLSFRMREPLSSISSVRSI

SEQ ID NO: 65289 - protein, 398 aa, Homo sapiens
MESGLLRPAPVSEVIVLHYNYTGKLRGARYQPGAGLRADAVVCLAVCAFIVLENLAVLLVLGRHPRFHAPMFLLLGSLTLSDLLAGAAYAANILLSGPLTLKLSPALWFAREGGVFVALTASVLSLLAIALERSLTMARRGPAPVSSRGRTLAMAAAAWGVSLLLGLLPALGWNCLGRLDACSTVLPLYAKAYVLFCVLAFVGILAAICALYARIYCQVRANARRLPARPGTAGTTSTRARRKPRSLALLRTLSVVLLAFVACWGPLFLLLLLDVACPARTCPVLLQADPFLGLAMANSLLNPIIYTLTNRDLRHALLRLVCCGRHSCGRDPSGSQQSASAAEASGGLRRCLPPGLDGSFSGSERSSPQRDGLDTSGSTGSPGAPTAARTLVSEPAAD

SEQ ID NO: 65290 - protein, 310 aa, Homo sapiens
MESGLLRPAPVSEVIVLHYNYTGKLRGARYQPGAGLRADAVVCLAVCAFIVLENLAVLLVLGRHPRFHAPMFLLLGSLTLSDLLAGAAYAANILLSGPLTLKLSPALWFAREGGVFVALTASVLSLLAIALERSLTMARRGPAPVSSRGRTLAMAAAAWGVSLLLGLLPALGWNCLGRLDACSTVLPLYAKAYVLFCVLAFVGILAAICALYALAGLAAHAQRGAPGLCGMLGPPLPAAVARRGVPGAHLSCTPAGRSLPGTGHGQLTSEPHHLHAHQPRPAPRAPAPGLLRTPLLRQRPEWLPAVGERG

SEQ ID NO: 65291 - protein, 398 aa, Homo sapiens; identical to SEQ ID NO: 65289

SEQ ID NO: 65292 - protein, 1671 aa, Homo sapiens
MDGNSLLSVPSNLESSRMYDVLEPQQGRGCGSSGSGPGNSITACKKVLRSNSLLESTDYWLQNQRMPCQIGFVEDKSENCASVCFVNLDVNKDECSTEHLQQKLVNVSPDLPKLISSMNVQQPKENEIVVLSGLASGNLQADFEVSQCPWLPDICLVQCARGNRPNSTNCIIFEINKFLIGLELVQERQLHLETNILKLEDDTNCSLSSIEEDFLTASEHLEEESEVDESRNDYENINVSANVLESKQLKGATQVEWNCNKEKWLYALEDKYINKYPTPLIKTERSPENLTKNTALQSLDPSAKPSQWKREAVGNGRQATHYYHSEAFKGQMEKSQALYIPKDAYFSMMDKDVPSACAVAEQRSNLNPGDHEDTRNALPPRQDGEVTTGKYATNLAESVLQDAFIRLSQSQSTLPQESAVSVSVGSSLLPSCYSTKDTVVSRSWNELPKIVVVQSPDGSDAAPQPGISSWPEMEVSVETSSILSGENSSRQPQSALEVALACAATVIGTISSPQATERLKMEQVVSNFPPGSSGALQTQAPQGLKEPSINEYSFPSALCGMTQVASAVAVCGLGEREEVTCSVAPSGSLPPAAEASEAMPPLCGLASMELGKEAIAKGLLKEAALVLTRPNTYSSIGDFLDSMNRRIMETASKSQTLCSENVVRNELAHTLSNVILRHSIDEVHHKNMIIDPNDNRHSSEILDTLMESTNQLLLDVICFTFKKMSHIVRLGECPAVLSKETIRRRETEPSCQPSDPGASQAWTKATESSSSSPLSNSHNTSLVINNLVDGMYSKQDKGGVRPGLFKNPTLQSQLSRSHRVPDSSTATTSSKEIYLKGIAGEDTKSPHHSENECRASSEGQRSPTVSQSRSGSQEAEESIHPNTQEKYNCATSRINEVQVNLSLLGDDLLLPAQSTLQTKHPDIYCITDFAEELADTVVSMATEIAAICLDNSSGKQPWFCAWKRGSEFLMTPNVPCRSLKRKKESQGSGTAVRKHKPPRLSEIKRKTDEHPELKEKLMNRVVDESMNLEDVPDSVNLFANEVAAKIMNLTEFSMVDGMWQAQGYPRNRLLSGDRWSRLKASSCESIPEEDSEARAYVNSLGLMSTLSQPVSRASSVSKQSSCESITDEFSRFMVNQMENEGRGFELLLDYYAGKNASSILNSAMQQACRKSDHLSVRPSCPSKQSSTESITEEFYRYMLRDIERDSRESASSRRSSQDWTAGLLSPSLRSPVCHRQSSMPDSRSPCSRLTVNVPIKANSLDGFAQNCPQDFLSVQPVSSASSSGLCKSDSCLYRRGGTDHITNMLIHETWASSIEALMRKNKIIVDDAEEADTEPVSGGSPSQAEKCANRLAASRMCSGPTLLVQESLDCPRKDSVTECKQPPVSSLSKTASLTNHSPLDSKKETSSCQDPVPINHKRRSLCSREVPLIQIETDQREACAGEPEPFLSKSSLLEEAEGHSNDKNIPDVVRGGDTAVSACQIHSDSLDTRDVPEAEASTEARAPDEAPNPPSSSEESTGSWTQLANEEDNPDDTSSFLQLSERSMSELVEEKKILKGQSESTEAPASGPPTGTASPQRSLLVINFDLEPECPDAELRATLQWIAASELGIPTIYFKKSQENRIEKFLDVVQLVHRKSWKVGDIFHAVVQYCKMHEEQKDGRLSLFDWLLELG

SEQ ID NO: 65293 - protein, 1700 aa, Homo sapiens
MDGNSLLSVPSNLESSRMYDVLEPQQGRGCGSSGSGPGNSITACKKVLRSNSLLESTDYWLQNQRMPCQIGFVEDKSENCASVCFVNLDVNKDECSTEHLQQKLVNVSPDLPKLISSMNVQQPKENEIVVLSGLASGNLQADFEVSQCPWLPDICLVQCARGNRPNSTNCIIFEINKFLIGLELVQERQLHLETNILKLEDDTNCSLSSIEEDFLTASEHLEEESEVDESRNDYENINVSANVLESKQLKGATQVEWNCNKEKWLYALEDKYINKYPTPLIKTERSPENLTKNTALQSLDPSAKPSQWKREAVGNGRQATHYYHSEAFKGQMEKSQALYIPKDAYFSMMDKDVPSACAVAEQRSNLNPGDHEDTRNALPPRQDGEVTTGKYATNLAESVLQDAFIRLSQSQSTLPQESAVSVSVGSSLLPSCYSTKDTVVSRSWNELPKIVVVQSPDGSDAAPQPGISSWPEMEVSVETSSILSGENSSRQPQSALEVALACAATVIGTISSPQATERLKMEQVVSNFPPGSSGALQTQAPQGLKEPSINEYSFPSALCGMTQVASAVAVCGLGEREEVTCSVAPSGSLPPAAEASEAMPPLCGLASMELGKEAIAKGLLKEAALVLTRPNTYSSIGDFLDSMNRRIMETASKSQTLCSENVVRNELAHTLSNVILRHSIDEVHHKNMIIDPNDNRHSSEILDTLMESTNQLLLDVICFTFKKMSHIVRLGECPAVLSKETIRRRETEPSCQPSDPGASQAWTKATESSSSSPLSNSHNTSLVINNLVDGMYSKQDKGGVRPGLFKNPTLQSQLSRSHRVPDSSTATTSSKEIYLKGIAGEDTKSPHHSENECRASSEGQRSPTVSQSRSGSQEAEESIHPNTQEKYNCATSRINEVQVNLSLLGDDLLLPAQSTLQTKHPDIYCITDFAEELADTVVSMATEIAAICLDNSSGKQPWFCAWKRGSEFLMTPNVPCRSLKRKKESQGSGTAVRKHKPPRLSEIKRKTDEHPELKEKLMNRVVDESMNLEDVPDSVNLFANEVAAKIMNLTEFSMVDGMWQAQGYPRNRLLSGDRWSRLKASSCESIPEEDSEARAYVNSLGLMSTLSQPVSRASSVSKQSSCESITDEFSRFMVNQMENEGRGFELLLDYYAGKNASSILNSAMQQACRKSDHLSVRPSCPSKQSSTESITEEFYRYMLRDIERDSRESASSRRSSQDWTAGLLSPSLRSPVCHRQSSMPDSRSPCSRLTVNVPIKANSLDGFAQNCPQDFLSVQPVSSASSSGLCKSDSCLYRRGGTDHITNMLIHETWASSIEALMRKNKIIVDDAEEADTEPVSGGSPSQAEKCANRLAASRMCSGPTLLVQESLDCPRKDSVTECKQPPVSSLSKTASLTNHSPLDSKKETSSCQDPVPINHKRRSLCSREVPLIQIETDQREACAGEPEPFLSKSSLLEEAEGHSNDKNIPDVVRGGDTAVSACQIHSDSLDTRDVPEAEASTEARAPDEAPNPPSSSEESTGSWTQLANEEDNPDDTSSFLQLSERSMSNGNSSATSSLGIMDLDIYQESMPSSPMINELVEEKKILKGQSESTEAPASGPPTGTASPQRSLLVINFDLEPECPDAELRATLQWIAASELGIPTIYFKKSQENRIEKFLDVVQLVHRKSWKVGDIFHAVVQYCKMHEEQKDGRLSLFDWLLELG

SEQ ID NO: 65294 - protein, 262 aa, Homo sapiens
MLALEAAQLDGPHFSCLYPDGVFYDLDSCKHSSYPDSEGAPDSLWDWTVAPPVPATPYEAFDPAAAAFSHPQAAQLCYEPPTYSPAGNLELAPSLEAPGPGLPAYPTENFASQTLVPPAYAPYPSPVLSEEEDLPLDSPALEVSDSESDEALVAGPEGKGSEAGTRKKLRLYQFLLGLLTRGDMRECVWWVEPGAGVFQFSSKHKELLARRWGQQKGNRKRMTYQKLARALRNYAKTGEIRKVKRKLTYQFDSALLPAVRRA

SEQ ID NO: 65295 - protein, 171 aa, Homo sapiens
MASSMTWTAASIPATLIQRGLLTLVPPAYAPYPSPVLSEEEDLPLDSPALEVSDSESDEALVAGPEGKGSEAGTRKKLRLYQFLLGLLTRGDMRECVWWVEPGAGVFQFSSKHKELLARRWGQQKGNRKRMTYQKLARALRNYAKTGEIRKVKRKLTYQFDSALLPAVRRA

SEQ ID NO: 65296 - protein, 248 aa, Homo sapiens
MTCVEQDKLGQAFEDAFEVLRQHSTGDLQYSPDYRNYLALINHRPHVKGNSSCYGVLPTEEPVYNWRTVINSAADFYFEGNIHQSLQNITENQLVQPTLLQQKGGKGRKKLRLFEYLHESLYNPEMASCIQWVDKTKGIFQFVSKNKEKLAELWGKRKGNRKTMTYQKMARALRNYGRSGEITKIRRKLTYQFSEAILQRLSPSYFLGKEIFYSQCVQPDQEYLSLNNWNANYNYTYANYHELNHHDC

SEQ ID NO: 65297 - protein, 248 aa, Homo sapiens; identical to SEQ ID NO: 65296

SEQ ID NO: 65298 - protein, 855 aa, Homo sapiens
MSFVRVNRCGPRVGVRKTPKVKKKKTSVKQEWDNTVTDLTVHRATPEDLVRRHEIHKSKNRALVHWELQEKALKRKWRKQKPETLNLEKRRLSIMKEILSDQYQMQDVLEKSDHLIAAAKELFPRRRTGFPNVTVAPDSSQGPIVVNQDPITQSIFNESVIEPQALNDVDGEEEGTVNSQSGESENENELDNSLNSQSNTNTDRFLQQLTEENFELISKLWTDIQQKIATQSQITPPGTPSSALSSGEQRAALNATNAVKRLQTRLQPEESTETLDSSYVVGHVLNSRKQKQLLNKVKRKPNLHALSKPKKNISSGSTTSADLPNRTNSNLDVLKHMIHEVEHEMEEYERWTGREVKGLQSSQGLTGFTLSLVSSLCRLVRYLKESEIQLRKEVETRQQLEQVLGDHRELIDALTAEILRLREENAATQARLQQYMVTTDEQLISLTHAIKNCPVINNRQEIQASESGATGRRVMDSPERPVVNANVSVPLMFREEVAEFPQEELPVKLSQVPDPPDNMNLAKNFPAHIFEPAVLLTPPRQKSNLKFSPLQDVLRRTVQTRPAPRLPPTVEIIEKEQNWEEKTLPIDTDIQNSSEENRLFTQRWRVSHMGEDLENKTQAPFVNLSQPLCNSHSNTQQSRSPTFSEELPVLGDGQQLRTNESLIQRKDIMTRIADLTLQNSAIKAHMNNIIEPRGEQGDGLRELNKQESASDMTSTFPVAQSLTPGSMEERIAELNRQSMEARGKLLQLIEQQKLVGLNLSPPMSPVQLPLRAWTEGAKRTIEVSIPGAEAPESSKCSTVSPVSGINTRRSSGATGNSCSPLNATSGSGRFTPLNPRAKIEKQNEEGWFALSTHVS

SEQ ID NO: 65299 - protein, 160 aa, Homo sapiens
MSFVRVNRCGPRVGVRKTPKVKKKKTSVKQEWDNTVTDLTVHRATPEDLVRRHEIHKSKNRALVHWELQEKALKRKWRKQKPETLNLEKRRLSIMKEILSDQYQMQDVLEKSDHLIAAAKELFPRRRTGFPNVTVAPDSSQGPIVVNQDPITQSIFNESV

SEQ ID NO: 65300 - protein, 173 aa, Homo sapiens
MSFVRVNRCGPRVGVRKTPKVKKKKTSVKQEWDNTVTDLTVHRATPEDLVRRHEIHKSKNRALVHWELQEKALKRKWRKQKPETLNLEKRRLSIMKEILSDQYQMQDVLEKSDHLIAAAKELFPRRRTGFPNVTVAPDSSQGPIVVNQDPITQSIFNESVIEPQALNDVDGEE

SEQ ID NO: 65301 - protein, 19 aa, Homo sapiens
MSFVRVNRCGPRVGVRKTP

SEQ ID NO: 65302 - protein, 262 aa, Homo sapiens
MKTPFGKTPGQRSRADAGHAGVSANMMKKRTSHKKHRSSVGPSKPVSQPRRNIVGCRIQHGWKEGNGPVTQWKGTVLDQVPVNPSLYLIKYDGFDCVYGLELNKDERVSALEVLPDRVATSRISDAHLADTMIGKAVEHMFETEDGSKDEWRGMVLARAPVMNTWFYITYEKDPVLYMYQLLDDYKEGDLRIMPDSNDSPPAEREPGEVVDSLVGKQVEYAKEDGSKRTGMVIHQVEAKPSVYFIKFDDDFHIYVYDLVKTS

SEQ ID NO: 65303 - protein, 262 aa, Homo sapiens; identical to SEQ ID NO: 65302

SEQ ID NO: 65304 - protein, 528 aa, Homo sapiens
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 65305 - protein, 455 aa, Homo sapiens
MDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 65306 - protein, 476 aa, Homo sapiens
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 65307 - protein, 454 aa, Homo sapiens
MAGSDTAPFLSQADDPDDGPVPGTPGLPGSTGNPKSEEPEVPDQEGLQRITGLSPGRSALIVAVLCYINLLNYMDRFTVAVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 65308 - protein, 549 aa, Homo sapiens
MMCLECASAAAGGAEEEEADAERRRRRRGAQRGAGGSGCCGARGAGGAGVSAAGDEVQTLSGSVRRAPTGPPGTPGTPGCAATAKGPGAQQPKPASLGRGRGAAAAILSLGNVLNYLDRYTVAGVLLDIQQHFGVKDRGAGLLQSVFICSFMVAAPIFGYLGDRFNRKVILSCGIFFWSAVTFSSSFIPQQYFWLLVLSRGLVGIGEASYSTIAPTIIGDLFTKNTRTLMLSVFYFAIPLGSGLGYITGSSVKQAAGDWHWALRVSPVLGMITGTLILILVPATKRGHADQLGDQLKARTSWLRDMKALIRNRSYVFSSLATSAVSFATGALGMWIPLYLHRAQVVQKTAETCNSPPCGAKDSLIFGAITCFTGFLGVVTGAGATRWCRLKTQRADPLVCAVGMLGSAIFICLIFVAAKSSIVGAYICIFVGETLLFSNWAITADILMYVVIPTRRATAVALQSFTSHLLGDAGSPYLIGFISDLIRQSTKDSPLWEFLSLGYALMLCPFVVVLGGMFFLATALFFVSDRARAEQQVNQLAMPPASVKV

SEQ ID NO: 65309 - protein, 385 aa, Homo sapiens
MLVCFRLYSWLFFLSRGIVGTGSASYSTIAPTVLGDLFVRDQRTRVLAVFYIFIPVGSGLGYVLGSAVTMLTGNWRWALRVMPCLEAVALILLILLVPDPPRGAAETQGEGAVGGFRSSWCEDVRYLGKNWSFVWSTLGVTAMAFVTGALGFWAPKFLLEARVVHGLQPPCFQEPCSNPDSLIFGALTIMTGVIGVILGAEAARRYKKVIPGAEPLICASSLLATAPCLYLALVLAPTTLLASYVFLGLGELLLSCNWAVVADILLSVVVPRCRGTAEALQITVGHILGDAGSPYLTGLISSVLRARRPDSYLQRFRSLQQSFLCCAFVIALGGGCFLLTALYLERDETRAWQPVTGTPDSNDVDSNDLERQGLLSGAGASTEEP

SEQ ID NO: 65310 - protein, 512 aa, Homo sapiens
MAGGMSAECPEPGPGGLQGQSPGPGRQCPPPITPTSWSLPPWRAYVAAAVLCYINLLNYMNWFIIAGVLLDIQEVFQISDNHAGLLQTVFVSCLLLSAPVFGYLGDRHSRKATMSFGILLWSGAGLSSSFISPRYSWLFFLSRGIVGTGSASYSTIAPTVLGDLFVRDQRTRVLAVFYIFIPVGSGLGYVLGSAVTMLTGNWRWALRVMPCLEAVALILLILLVPDPPRGAAETQGEGAVGGFRSSWCEDVRYLGKNWSFVWSTLGVTAMAFVTGALGFWAPKFLLEARVVHGLQPPCFQEPCSNPDSLIFGALTIMTGVIGVILGAEAARRYKKVIPGAEPLICASSLLATAPCLYLALVLAPTTLLASYVFLGLGELLLSCNWAVVADILLSVVVPRCRGTAEALQITVGHILGDAGSPYLTGLISSVLRARRPDSYLQRFRSLQQSFLCCAFVIALGGGCFLLTALYLERDETRAWQPVTGTPDSNDVDSNDLERQGLLSGAGASTEEP

SEQ ID NO: 65311 - protein, 82 aa, Homo sapiens
MGQTALAGGSSSTPTPQALYPDLSCPEGLEELLSAPPPDLGAQRRHGWNPKDCSENIEVKEGGLYFERRPVAQSTDGARGKR

SEQ ID NO: 65312 - protein, 263 aa, Homo sapiens
MGQTALAGGSSSTPTPQALYPDLSCPEGLEELLSAPPPDLGAQRRHGWNPKDCSENIEVKEGGLYFERRPVAQSTDGARGKRGYSRGLHAWEISWPLEQRGTHAVVGVATALAPLQTDHYAALLGSNSESWGWDIGRGKLYHQSKGPGAPQYPAGTQGEQLEVPERLLVVLDMEEGTLGYAIGGTYLGPAFRGLKGRTLYPAVSAVWGQCQVRIRYLGERRAEPHSLLHLSRLCVRHNLGDTRLGQVSALPLPPAMKRYLLYQ

SEQ ID NO: 65313 - protein, 263 aa, Homo sapiens; identical to SEQ ID NO: 65312

SEQ ID NO: 65314 - protein, 355 aa, Homo sapiens
MARRPRNSRAWHFVLSAARRDADARAVALAGSTNWGYDSDGQHSDSDSDPEYSTLPPSIPSAVPVTGESFCDCAGQSEASFCSSLHSAHRGRDCRCGEEDEYFDWVWDDLNKSSATLLSCDNRKVSFHMEYSCGTAAIRGTKELGEGQHFWEIKMTSPVYGTDMMVGIGTSDVDLDKYRHTFCSLLGRDEDSWGLSYTGLLHHKGDKTSFSSRFGQGSIIGVHLDTWHGTLTFFKNRKCIGVAATKLQNKRFYPMVCSTAARSSMKVTRSCASATSLQYLCCHRLRQLRPDSGDTLEGLPLPPGLKQVLHNKLGWVLSMSCSRRKAPVSDPQAATSAHPSSREPRPCQRKRCRRT

SEQ ID NO: 65315 - protein, 159 aa, Homo sapiens
MEYSCGTAAIRGTKELGEGQHFWEIKMTSPVYGTLTFFKNRKCIGVAATKLQNKRFYPMVCSTAARSSMKVTRSCASATSLQYLCCHRLRQLRPDSGDTLEGLPLPPGLKQVLHNKLGWVLSMSCSRRKAPVSDPQAATSAHPSSREPRPCQRKRCRRT

SEQ ID NO: 65316 - protein, 355 aa, Homo sapiens; identical to SEQ ID NO: 65314

SEQ ID NO: 65317 - protein, 273 aa, Homo sapiens
MGQKLSGSLKSVEVREPALRPAKRELRGAEPGRPARLDQLLDMPAAGLAVQLRHAWNPEDRSLNVFVKDDDRLTFHRHPVAQSTDGIRGKVGHARGLHAWQINWPARQRGTHAVVGVATARAPLHSVGYTALVGSDAESWGWDLGRSRLYHDGKNQPGVAYPAFLGPDEAFALPDSLLVVLDMDEGTLSFIVDGQYLGVAFRGLKGKKLYPVVSAVWGHCEVTMRYINGLDPEPLPLMDLCRRSIRSALGRQRLQDISSLPLPQSLKNYLQYQ

SEQ ID NO: 65318 - protein, 635 aa, Homo sapiens
MASSGMADSANHLPFFFGNITREEAEDYLVQGGMSDGLYLLRQSRNYLGGFALSVAHGRKAHHYTIERELNGTYAIAGGRTHASPADLCHYHSQESDGLVCLLKKPFNRPQGVQPKTGPFEDLKENLIREYVKQTWNLQGQALEQAIISQKPQLEKLIATTAHEKMPWFHGKISREESEQIVLIGSKTNGKFLIRARDNNGSYALCLLHEGKVLHYRIDKDKTGKLSIPEGKKFDTLWQLVEHYSYKADGLLRVLTVPCQKIGTQGNVNFGGRPQLPGSHPATWSAGGIISRIKSYSFPKPGHRKSSPAQGNRQESTVSFNPYEPELAPWAADKGPQREALPMDTEVYESPYADPEEIRPKEVYLDRKLLTLEDKELGSGNFGTVKKGYYQMKKVVKTVAVKILKNEANDPALKDELLAEANVMQQLDNPYIVRMIGICEAESWMLVMEMAELGPLNKYLQQNRHVKDKNIIELVHQVSMGMKYLEESNFVHRDLAARNVLLVTQHYAKISDFGLSKALRADENYYKAQTHGKWPVKWYAPECINYYKFSSKSDVWSFGVLMWEAFSYGQKPYRGMKGSEVTAMLEKGERMGCPAGCPREMYDLMNLCWTYDVENRPGFAAVELRLRNYYYDVVN

SEQ ID NO: 65319 - protein, 612 aa, Homo sapiens
MASSGMADSANHLPFFFGNITREEAEDYLVQGGMSDGLYLLRQSRNYLGGFALSVAHGRKAHHYTIERELNGTYAIAGGRTHASPADLCHYHSQESDGLVCLLKKPFNRPQGVQPKTGPFEDLKENLIREYVKQTWNLQGQALEQAIISQKPQLEKLIATTAHEKMPWFHGKISREESEQIVLIGSKTNGKFLIRARDNNGSYALCLLHEGKVLHYRIDKDKTGKLSIPEGKKFDTLWQLVEHYSYKADGLLRVLTVPCQKIGTQGNVNFGGRPQLPGSHPASSPAQGNRQESTVSFNPYEPELAPWAADKGPQREALPMDTEVYESPYADPEEIRPKEVYLDRKLLTLEDKELGSGNFGTVKKGYYQMKKVVKTVAVKILKNEANDPALKDELLAEANVMQQLDNPYIVRMIGICEAESWMLVMEMAELGPLNKYLQQNRHVKDKNIIELVHQVSMGMKYLEESNFVHRDLAARNVLLVTQHYAKISDFGLSKALRADENYYKAQTHGKWPVKWYAPECINYYKFSSKSDVWSFGVLMWEAFSYGQKPYRGMKGSEVTAMLEKGERMGCPAGCPREMYDLMNLCWTYDVENRPGFAAVELRLRNYYYDVVN

SEQ ID NO: 65320 - protein, 612 aa, Homo sapiens; identical to SEQ ID NO: 65319

SEQ ID NO: 65321 - protein, 635 aa, Homo sapiens; identical to SEQ ID NO: 65318

SEQ ID NO: 65322 - protein, 548 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQRSLPAAAMARAMRVRTFRAHW

SEQ ID NO: 65323 - protein, 638 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPPGVQPPLPPGAPPPPPPPPPGSAGMMIPPRGGDGPSHESEDFPRPLVTLPGRQPQQRPWWTGWFGKAA

SEQ ID NO: 65324 - protein, 639 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPPGVQPPLPPGAPPPPPPPPPGSAGMMYAPPPPPPPPMDPSNFVTMMGMGVAGMPPFGMPPAPPPPPPQN

SEQ ID NO: 65325 - protein, 571 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMGKSVPGKYACGLWGLSPASRKRYDAATTYGHDAAAAAASQWAAPTPSLWSSSPMATTAAAASATPSAQQQYGFQYPLAMAAKIPPRGGDGPSHESEDFPRPLVTLPGRQPQQRPWWTGWFGKAA

SEQ ID NO: 65326 - protein, 433 aa, Homo sapiens
MVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQRSLPAAAMARAMRVRTFRAHW

SEQ ID NO: 65327 - protein, 673 aa, Homo sapiens
MATGANATPLGKLGPPGLPPLPGPKGGFEPGPPPAPGPGAGLLAPGPPPPPPVGSMGALTAAFPFAALPPPPPPPPPPPPQQPPPPPPPPSPGASYPPPQPPPPPPLYQRVSPPQPPPPQPPRKDQQPGPAGGGGDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQRSLPAAAMARAMRVRTFRAHW

SEQ ID NO: 65328 - protein, 613 aa, Homo sapiens
MEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPPGVQPPLPPGAPPPPPPPPPGSAGMMYAPPPPPPPPMDPSNFVTMMGMGVAGMPPFGMPPAPPPPPPQN

SEQ ID NO: 65329 - protein, 793 aa, Homo sapiens
MPAGPVQAVPPPPPVPTEPKQPTEEEASSKEDSAPSKPVVGIIYPPPEVRNIVDKTASFVARNGPEFEARIRQNEINNPKFNFLNPNDPYHAYYRHKVSEFKEGKAQEPSAAIPKVMQQQQQTTQQQLPQKVQAQVIQETIVPKEPPPEFEFIADPPSISAFDLDVVKLTAQFVARNGRQFLTQLMQKEQRNYQFDFLRPQHSLFNYFTKLVEQYTKILIPPKGLFSKLKKEAENPREVLDQVCYRVEWAKFQERERKKEEEEKEKERVAYAQIDWHDFVVVETVDFQPNEQGNFPPPTTPEELGARILIQERYEKFGESEEVEMEVESDEEDDKQEKAEEPPSQLDQDTQVQDMDEGSDDEEEGQKVPPPPETPMPPPLPPTPDQVIVRKDYDPKASKPLPPAPAPDEYLVSPITGEKIPASKMQEHMRIGLLDPRWLEQRDRSIREKQSDDEVYAPGLDIESSLKQLAERRTDIFGVEETAIGKKIGEEEIQKPEEKVTWDGHSGSMARTQQAAQANITLQEQIEAIHKAKGLVPEDDTKEKIGPSKPNEIPQQPPPPSSATNIPSSAPPITSVPRPPTMPPPVRTTVVSAVPVMPRPPMASVVRLPPGSVIAPMPPIIHAPRINVVPMPPSAPPIMAPRPPPMIVPTAFVPAPPVAPVPAPAPMPPVHPPPPMEDEPTSKKLKTEDSLMPEEEFLRRNKGPVSIKVQVPNMQDKTEWKLNGQVLVFTLPLTDQVSVIKVKIHEATGMPAGKQKLQYEGIFIKDSNSLAYYNMANGAVIHLALKERGGRKK

SEQ ID NO: 65330 - protein, 728 aa, Homo sapiens
MPAGPVQAVPPPPPVPTEPKQPTEEEASSKEDSAPSKPVVGIIYPPPEVRNIVDKTASFVARNGPEFEARIRQNEINNPKFNFLNPNDPYHAYYRHKVSEFKEGKAQFVARNGRQFLTQLMQKEQRNYQFDFLRPQHSLFNYFTKLVEQYTKILIPPKGLFSKLKKEAENPREVLDQVCYRVEWAKFQERERKKEEEEKEKERVAYAQIDWHDFVVVETVDFQPNEQGNFPPPTTPEELGARILIQERYEKFGESEEVEMEVESDEEDDKQEKAEEPPSQLDQDTQVQDMDEGSDDEEEGQKVPPPPETPMPPPLPPTPDQVIVRKDYDPKASKPLPPAPAPDEYLVSPITGEKIPASKMQEHMRIGLLDPRWLEQRDRSIREKQSDDEVYAPGLDIESSLKQLAERRTDIFGVEETAIGKKIGEEEIQKPEEKVTWDGHSGSMARTQQAAQANITLQEQIEAIHKAKGLVPEDDTKEKIGPSKPNEIPQQPPPPSSATNIPSSAPPITSVPRPPTMPPPVRTTVVSAVPVMPRPPMASVVRLPPGSVIAPMPPIIHAPRINVVPMPPSAPPIMAPRPPPMIVPTAFVPAPPVAPVPAPAPMPPVHPPPPMEDEPTSKKLKTEDSLMPEEEFLRRNKGPVSIKVQVPNMQDKTEWKLNGQVLVFTLPLTDQVSVIKVKIHEATGMPAGKQKLQYEGIFIKDSNSLAYYNMANGAVIHLALKERGGRKK

SEQ ID NO: 65331 - protein, 690 aa, Homo sapiens
MTLTMPTTAIPKVMQQQQQTTQQQLPQKVQAQVIQETIVPKEPPPEFEFIADPPSISAFDLDVVKLTAQFVARNGRQFLTQLMQKEQRNYQFDFLRPQHSLFNYFTKLVEQYTKILIPPKGLFSKLKKEAENPREVLDQVCYRVEWAKFQERERKKEEEEKEKERVAYAQIDWHDFVVVETVDFQPNEQGNFPPPTTPEELGARILIQERYEKFGESEEVEMEVESDEEDDKQEKAEEPPSQLDQDTQVQDMDEGSDDEEEGQKVPPPPETPMPPPLPPTPDQVIVRKDYDPKASKPLPPAPAPDEYLVSPITGEKIPASKMQEHMRIGLLDPRWLEQRDRSIREKQSDDEVYAPGLDIESSLKQLAERRTDIFGVEETAIGKKIGEEEIQKPEEKVTWDGHSGSMARTQQAAQANITLQEQIEAIHKAKGLVPEDDTKEKIGPSKPNEIPQQPPPPSSATNIPSSAPPITSVPRPPTMPPPVRTTVVSAVPVMPRPPMASVVRLPPGSVIAPMPPIIHAPRINVVPMPPSAPPIMAPRPPPMIVPTAFVPAPPVAPVPAPAPMPPVHPPPPMEDEPTSKKLKTEDSLMPEEEFLRRNKGPVSIKVQVPNMQDKTEWKLNGQVLVFTLPLTDQVSVIKVKIHEATGMPAGKQKLQYEGIFIKDSNSLAYYNMANGAVIHLALKERGGRKK

SEQ ID NO: 65332 - protein, 464 aa, Homo sapiens
MDFQHRPGGKTGSGGVASSSESNRDRRERLRQLALETIDINKDPYFMKNHLGSYECKLCLTLHNNEGSYLAHTQGKKHQTNLARRAAKEAKEAPAQPAPEKVKVEVKKFVKIGRPGYKVTKQRDSEMGQQSLLFQIDYPEIAEGIMPRHRFMSAYEQRIEPPDRRWQYLLMAAEPYETIAFKVPSREIDKAEGKFWTHWNRETKQFFLQFHFKMEKPPAPPSLPAGPPGVKRPPPPLMNGLPPRPPLPESLPPPPPGGLPLPPMPPTGPAPSGPPGPPQLPPPAPGVHPPAPVVHPPASGVHPPAPGVHPPAPGVHPPAPGVHPPTSGVHPPAPGVHPPAPGVHPPAPGVHPPAPGVHPPAPGVHPPPSAGVHPQAPGVHPAAPAVHPQAPGVHPPAPGMHPQAPGVHPQPPGVHPSAPGVHPQPPGVHPSNPGVHPPTPMPPMLRPPLPSEGPGNIPPPPPTN

SEQ ID NO: 65333 - protein, 1304 aa, Homo sapiens
MAKIAKTHEDIEAQIREIQGKKAALDEAQGVGLDSTGYYDQEIYGGSDSRFAGYVTSIAATELEDDDDDYSSSTSLLGQKKPGYHAPVALLNDIPQSTEQYDPFAEHRPPKIADREDEYKKHRRTMIISPERLDPFADGGKTPDPKMNARTYMDVMREQHLTKEEREIRQQLAEKAKAGELKVVNGAAASQPPSKRKRRWDQTADQTPGATPKKLSSWDQAETPGHTPSLRWDETPGRAKGSETPGATPGSKIWDPTPSHTPAGAATPGRGDTPGHATPGHGGATSSARKNRWDETPKTERDTPGHGSGWAETPRTDRGGDSIGETPTPGASKRKSRWDETPASQMGGSTPVLTPGKTPIGTPAMNMATPTPGHIMSMTPEQLQAWRWEREIDERNRPLSDEELDAMFPEGYKVLPPPAGYVPIRTPARKLTATPTPLGGMTGFHMQTEDRTMKSVNDQPSGNLPFLKPDDIQYFDKLLVDVDESTLSPEEQKERKIMKLLLKIKNGTPPMRKAALRQITDKAREFGAGPLFNQILPLLMSPTLEDQERHLLVKVIDRILYKLDDLVRPYVHKILVVIEPLLIDEDYYARVEGREIISNLAKAAGLATMISTMRPDIDNMDEYVRNTTARAFAVVASALGIPSLLPFLKAVCKSKKSWQARHTGIKIVQQIAILMGCAILPHLRSLVEIIEHGLVDEQQKVRTISALAIAALAEAATPYGIESFDSVLKPLWKGIRQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 65334 - protein, 144 aa, Homo sapiens
MAKIAKTHEDIEAQIREIQGKKAALDEAQGVGLDSTGYYDQEIYGGSDSRFAGYVTSIAATELEDDDDDYSSSTSLLGQKKPGYHAPVALLNDIPQSTEQYDPFAEHRPPKIADREDEYKKHRRTMIISPERLDPFADGFYSAA

SEQ ID NO: 65335 - protein, 144 aa, Homo sapiens; identical to SEQ ID NO: 65334

SEQ ID NO: 65336 - protein, 895 aa, Homo sapiens
MATEHPEPPKAELQLPPPPPPGHYGAWAAQELQAKLAEIGAPIQGNREELVERLQSYTRQTGIVLNRPVLRGEDGDKAAPPPMSAQLPGIPMPPPPLGLPPLQPPPPPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 65337 - protein, 799 aa, Homo sapiens
AKMATEHPEPPKAELQLPPPPPPGHYGAWAAQELQAKLAEIGAPIQGNREELVERLQSYTRQTGIVLNRPVLRGEDGDKAAPPPMSAQLPGIPMPPPPLGLPPLQPPPPPPPPPPGLGLGFPMAHPPNLGPPPPLRVGEPVALSEEERLKLAQQQAALLMQQEERAKQGDHSLKEHELLEQQKRAAVLLEQERQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 65338 - protein, 1217 aa, Homo sapiens
MFLYNLTLQRATGISFAIHGNFSGTKQQEIVVSRGKILELLRPDPNTGKVHTLLTVEVFGVIRSLMAFRLTGGTKDYIVVGSDSGRIVILEYQPSKNMFEKIHQETFGKSGCRRIVPGQFLAVDPKGRAVMISAIEKQKLVYILNRDAAARLTISSPLEAHKANTLVYHVVGVDVGFENPMFACLEMDYEEADNDPTGEAAANTQQTLTFYELDLGLNHVVRKYSEPLEEHGNFLITVPGGSDGPSGVLICSENYITYKNFGDQPDIRCPIPRRRNDLDDPERGMIFVCSATHKTKSMFFFLAQTEQGDIFKITLETDEDMVTEIRLKYFDTVPVAAAMCVLKTGFLFVASEFGNHYLYQIAHLGDDDEEPEFSSAMPLEEGDTFFFQPRPLKNLVLVDELDSLSPILFCQIADLANEDTPQLYVACGRGPRSSLRVLRHGLEVSEMAVSELPGNPNAVWTVRRHIEDEFDAYIIVSFVNATLVLSIGETVEEVTDSGFLGTTPTLSCSLLGDDALVQVYPDGIRHIRADKRVNEWKTPGKKTIVKCAVNQRQVVIALTGGELVYFEMDPSGQLNEYTERKEMSADVVCMSLANVPPGEQRSRFLAVGLVDNTVRIISLDPSDCLQPLSMQALPAQPESLCIVEMGGTEKQDELGERGSIGFLYLNIGLQNGVLLRTVLDPVTGDLSDTRTRYLGSRPVKLFRVRMQGQEAVLAMSSRSWLSYSYQSRFHLTPLSYETLEFASGFASEQCPEGIVAISTNTLRILALEKLGAVFNQVAFPLQYTPRKFVIHPESNNLIIIETDHNAYTEATKAQRKQQMAEEMVEAAGEDERELAAEMAAAFLNENLPESIFGAPKAGNGQWASVIRVMNPIQGNTLDLVQLEQNEAAFSVAVCRFSNTGEDWYVLVGVAKDLILNPRSVAGGFVYTYKLVNNGEKLEFLHKTPVEEVPAAIAPFQGRVLIGVGKLLRVYDLGKKKLLRKCENKHIANYISGIQTIGHRVIVSDVQESFIWVRYKRNENQLIIFADDTYPRWVTTASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFPVKNVIDGDLCEQFNSMEPNKQKNVSEELDRTPPEVSKKLEDIRTRYAF

SEQ ID NO: 65339 - protein, 275 aa, Homo sapiens
MFLYNLTLQRATGISFAIHGNFSGTKQQEIVVSRGKILELLRPDPNTGKVHTLLTVEVFGVIRSLMAFRLTGGTKDYIVVGSDSGRIVILEYQPSKNMFEKIHQETFGKSGCRRIVPGQFLAVDPKGRAVMISAIEKQKLVYILNRDAAARLTISSPLEAHKANTLVYHVVGVDVGFENPMFACLEMDYEEADNDPTGEAAANTQQTLTFYELDLGLNHVVRKYSEPLEEHGNFLITVPGGSDGPSGVLNLSPPFPKAIPALICLDSPVYFCTHP

SEQ ID NO: 65340 - protein, 424 aa, Homo sapiens
MAAGPISERNQDATVYVGGLDEKVSEPLLWELFLQAGPVVNTHMPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLPPPGMPPPGSFPPPVPPPGALPPGIPPAMPPPPMPPGAAGHGPPSAGTPGAGHPGHGHSHPHPFPPGGMPHPGMSQMQLAHHGPHGLGHPHAGPPGSGGQPPPRPPPGMPHPGPPPMGMPPRGPPFGSPMGHPGPMPPHGMRGPPPLMPPHGYTGPPRPPPYGYQRGPLPPPRPTPRPPVPPRGPLRGPLPQ

SEQ ID NO: 65341 - protein, 190 aa, Homo sapiens
MPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLP

SEQ ID NO: 65342 - protein, 707 aa, Homo sapiens
MSRDRFRSRGGGGGGFHRRGGGGGRGGLHDFRSPPPGMGLNQNRGPMGPGPGQSGPKPPIPPPPPHQQQQQPPPQQPPPQQPPPHQPPPHPQPHQQQQPPPPPQDSSKPVVAQGPGPAPGVGSAPPASSSAPPATPPTSGAPPGSGPGPTPTPPPAVTSAPPGAPPPTPPSSGVPTTPPQAGGPPPPPAAVPGPGPGPKQGPGPGGPKGGKMPGGPKPGGGPGLSTPGGHPKPPHRGGGEPRGGRQHHPPYHQQHHQGPPPGGPGGRSEEKISDSEGFKANLSLLRRPGEKTYTQRCRLFVGNLPADITEDEFKRLFAKYGEPGEVFINKGKGFGFIKLESRALAEIAKAELDDTPMRGRQLRVRFATHAAALSVRNLSPYVSNELLEEAFSQFGPIERAVVIVDDRGRSTGKGIVEFASKPAARKAFERCSEGVFLLTTTPRPVIVEPLEQLDDEDGLPEKLAQKNPMYQKERETPPRFAQHGTFEYEYSQRWKSLDEMEKQQREQVEKNMKDAKDKLESEMEDAYHEHQANLLRQDLMRRQEELRRMEELHNQEMQKRKEMQLRQEEERRRREEEMMIRQREMEEQMRRQREESYSRMGYMDPRERDMRMGGGGAMNMGDPYGSGGQKFPPLGGGGGIGYEANPGVPPATMSGSMMGSDMRTERFGQGGAGPVGGQGPRGMGPGTPAGYGRGREEYEGPNKKPRF

SEQ ID NO: 65343 - protein, 624 aa, Homo sapiens
MNSGGGFGLGLGFGLTPTSVIQVTNLSSAVTSEQMRTLFSFLGEIEELRLYPPDNAPLAFSSKVCYVKFRDPSSVGVAQHLTNTVFIDRALIVVPCAEGKIPEESKALSLLAPAPTMTSLMPGAGLLPIPTPNPLTTLGVSLSSLGAIPAAALDPNIATLGEIPQPPLMGNVDPSKIDEIRRTVYVGNLNSQTTTADQLLEFFKQVGEVKFVRMAGDETQPTRFAFVEFADQNSVPRALAFNGVMFGDRPLKINHSNNAIVKPPEMTPQAAAKELEEVMKRVREAQSFISAAIEPESGKSNERKGGRSRSHTRSKSRSSSKSHSRRKRSQSKHRSRSHNRSRSRQKDRRRSKSPHKKRSKSRERRKSRSRSHSRDKRKDTREKIKEKERVKEKDREKEREREKEREKEKERGKNKDRDKEREKDREKDKEKDREREREKEHEKDRDKEKEKEQDKEKEREKDRSKEIDEKRKKDKKSRTPPRSYNASRRSRSSSRERRRRRSRSSSRSPRTSKTIKRKSSRSPSPRSRNKKDKKREKERDHISERRERERSTSMRKSSNDRDGKEKLEKNSTSLKEKEHNKEPDSSVSKEVDDKDAPRTEENKIQHNGNCQLNEENLSTKTEAV

SEQ ID NO: 65344 - protein, 508 aa, Homo sapiens
MTSLMPGAGLLPIPTPNPLTTLGVSLSSLGAIPAAALDPNIATLGEIPQPPLMGNVDPSKIDEIRRTVYVGNLNSQTTTADQLLEFFKQVGEVKFVRMAGDETQPTRFAFVEFADQNSVPRALAFNGVMFGDRPLKINHSNNAIVKPPEMTPQAAAKELEEVMKRVREAQSFISAAIEPESGKSNERKGGRSRSHTRSKSRSSSKSHSRRKRSQSKHRSRSHNRSRSRQKDRRRSKSPHKKRSKSRERRKSRSRSHSRDKRKDTREKIKEKERVKEKDREKEREREKEREKEKERGKNKDRDKEREKDREKDKEKDREREREKEHEKDRDKEKEKEQDKEKEREKDRSKEIDEKRKKDKKSRTPPRSYNASRRSRSSSRERRRRRSRSSSRSPRTSKTIKRKSSRSPSPRSRNKKDKKREKERDHISERRERERSTSMRKSSNDRDGKEKLEKNSTSLKEKEHNKEPDSSVSKEVDDKDAPRTEENKIQHNGNCQLNEENLSTKTEAV

SEQ ID NO: 65345 - protein, 76 aa, Homo sapiens
MTSLMPGAGLLPIPTPNPLTTLGVSLSSLGAIPAAALDPNIATLGEIPQPPLMGNVDPSKIDEIRRTVYVGNLNSQ

SEQ ID NO: 65346 - protein, 514 aa, Homo sapiens
MNSGGGFGLGLGFGLTPTSVIQVTNLSSAVTSEQMRTLFSFLGEIEELRLYPPDNAPLAFSSKVCYVKFRDPSSVGVAQHLTNTVFIDRALIVVPCAEGKIPEESKALSLLAPAPTMTSLMPGAGLLPIPTPNPLTTLGVSLSSLGAIPAAALDPNIATLGEIPQPPLMGNVDPSKIDEIRRTVYVGNLNSQTTTADQLLEFFKQVGEVKFVRMAGDETQPTRFAFVEFADQNSVPRALAFNGVMFGDRPLKINHSNNAIVKPPEMTPQAAAKELEEVMKRVREAQSFISAAIEPESGKSNERKGGRSRSHTRSKSRSSSKSHSRRKRSQSKHRSRSHNRSRSRQKDRRRSKSPHKKRSKSRERRKSRSRSHSRDKRKDTREKIKEKERVKEKDREKEREREKEREKEKERGKNKDRDKEREKDREKDKEKDREREREKEHEKDRDKEKEKEQDKEKEREKDRSKEIDEKRKKDKNPEHHPGVTMHREDLVVPAGKGVGGGAGVLPDRQEHQKP

SEQ ID NO: 65347 - protein, 70 aa, Homo sapiens
MSEKKQPVDLGLLEEDDEFEEFPAEDWAGLDEDEDAHVWEDNWDDDNVEDDFSNQLRAELEKHGYKMETS

SEQ ID NO: 65348 - protein, 358 aa, Homo sapiens
MAFAPMGPEASFFDVLDRHRESLLAALRRGGREPPTGGSRLASRFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLRYIEEDGTKVNCTCGATAVAVPSNIQGIRNLVTDAKFVLIVEKDATFQRLLDDNFCNKLSPCIMITGKGVPDLNTRLLVKKLWDTFHVPVFTLVDADPHGIEIMCIYKYGSMSMSFEAHHLTVPAIRWLGLLPSDLKRLNVPKDSLIPLTKRDQMKLDSILRRPYVTCQPFWRKEMEIMADSKMKAEIQALTFLSSDYLSRVYLPNKLKFGGWI

SEQ ID NO: 65349 - protein, 354 aa, Homo sapiens
MAFAPMGPEASFFDVLDRHRESLLAALRRGGREPPTGGSRLASRFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLRYIEEDGTKVNCTCGATAVAVPSNIQGIRNAKFVLIVEKDATFQRLLDDNFCNKLSPCIMITGKGVPDLNTRLLVKKLWDTFHVPVFTLVDADPHGIEIMCIYKYGSMSMSFEAHHLTVPAIRWLGLLPSDLKRLNVPKDSLIPLTKRDQMKLDSILRRPYVTCQPFWRKEMEIMADSKMKAEIQALTFLSSDYLSRVYLPNKLKFGGWI

SEQ ID NO: 65350 - protein, 396 aa, Homo sapiens
MAFAPMGPEASFFDVLDRHRESLLAALRRGGREPPTGGSRLASSSEVLASIENIIQDIITSLARNEAPAFTIDNRSSWENIKFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLRYIEEDGTKVNCTCGATAVAVPSNIQGIRNLVTDAKFVLIVEKDATFQRLLDDNFCNKLSPCIMITGKGVPDLNTRLLVKKLWDTFHVPVFTLVDADPHGIEIMCIYKYGSMSMSFEAHHLTVPAIRWLGLLPSDLKRLNVPKDSLIPLTKRDQMKLDSILRRPYVTCQPFWRKEMEIMADSKMKAEIQALTFLSSDYLSRVYLPNKLKFGGWI

SEQ ID NO: 65351 - protein, 270 aa, Homo sapiens
LLAALRRGGREPPTGGSRLASSSEVLASIENIIQDIITSLARNEAPAFTIDNRSSWENIKFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLRYIEEDGTKVNCTCGATAVAVPSNIQGIRITDAKFVLIVEKDATFQRLLDDNFCNKLSPCIMITGKGVPDLNTRLLVKKLWDTFHVPVFTLVDADPHGIEIMCIYKYGSM

SEQ ID NO: 65352 - protein, 331 aa, Homo sapiens
MENPSPAAALGKALCALLLATLGAAGQPLGGESICSARALAKYSITFTGKWSQTAFPKQYPLFRPPAQWSSLLGAAHSSDYSMWRKNQYVSNGLRDFAERGEAWALMKEIEAAGEALQSVHAVFSAPAVPSGTGQTSAELEVQRRHSLVSFVVRIVPSPDWFVGVDSLDLCDGDRWREQAALDLYPYDAGTDSGFTFSSPNFATIPQDTVTEITSSSPSHPANSFYYPRLKALPPIARVTLVRLRQSPRAFIPPAPVLPSRDNEIVDSASVPETPLDCEVSLWSSWGLCGGHCGRLGTKSRTRYVRVQPANNGSPCPELEEEAECVPDNCV

SEQ ID NO: 65353 - protein, 331 aa, Homo sapiens; identical to SEQ ID NO: 65352

SEQ ID NO: 65354 - protein, 61 aa, Homo sapiens
MENPSPAAALGKALCALLLATLGAAGQPLGGESICSARALAKYSITFTGKWSQTAFPKQYP

SEQ ID NO: 65355 - protein, 108 aa, Homo sapiens
MENPSPAAALGKALCALLLATLGAAGQPLGGESICSARALAKYSITFTGKWSQTAFPKQYPLFRPPAQWSSLLGAAHSSDYSMWRKNQYVSNGLRDFAERGEAWALMK

SEQ ID NO: 65356 - protein, 17 aa, Homo sapiens
MENPSPAAALGKALCAL

SEQ ID NO: 65357 - protein, 8 aa, Homo sapiens
MENPSPAA

SEQ ID NO: 65358 - protein, 16 aa, Homo sapiens
MENPSPAAALGKALCA

SEQ ID NO: 65359 - protein, 24 aa, Homo sapiens
MENPSPAAALGKALCALLLATLGA

SEQ ID NO: 65360 - protein, 64 aa, Homo sapiens
MENPSPAAALGKALCALLLATLGAAGQPLGGESICSARALAKYSITFTGKWSQTAFPKQYPLFR

SEQ ID NO: 65361 - protein, 319 aa, Homo sapiens
MDPQNQHGSGSSLVVIQQPSLDSRQRLDYEREIQPTAILSLDQIKAIRGSNEYTEGPSVVKRPAPRTAPRQEKHERTHEIIPINVNNNYEHRHTSHLGHAVLPSNARGPILSRSTSTGSAASSGSNSSASSEQGLLGRSPPTRPVPGHRSERAIRTQPKQLIVDDLKGSLKEDLTQHKFICEQCGKCKCGECTAPRTLPSCLACNRQCLCSAESMVEYGTCMCLVKGIFYHCSNDDEGDSYSDNPCSCSQSHCCSRYLCMGAMSLFLPCLLCYPPAKGCLKLCRRCYDWIHRPGCRCKNSNTVYCKLESCPSRGQGKPS

SEQ ID NO: 65362 - protein, 319 aa, Homo sapiens; identical to SEQ ID NO: 65361

SEQ ID NO: 65363 - protein, 67 aa, Homo sapiens
MDPQNQHGSGSSLVVIQQPSLDSRQRLDYEREIQPTAILSLDQIKAIRGSNEYTEGPSVVKRPAPRT

SEQ ID NO: 65364 - protein, 209 aa, Homo sapiens
MDPQNQHGSGSSLVVIQQPSLDSRQRLDYEREIQPTAILSLDQIKAIRGSNEYTEGPSVVKRPAPRTAPRQEKHERTHEIIPINVNNNYEHRHTSHLGHAVLPSNARGPILSRSTSTGSAASSGSNSSASSEQGLLGRSPPTRPVPGHRSERAIRTQPKQLIVDDLKGSLKEDLTQHKFICEQCGKCKCGECTAPRTLPSCLACNRQCL

SEQ ID NO: 65365 - protein, 35 aa, Homo sapiens
MDPQNQHGSGSSLVVIQQPSLDSRQRLDYEREIQP

SEQ ID NO: 65366 - protein, 315 aa, Homo sapiens
MEARAQSGNGSQPLLQTPRDGGRQRGEPDPRDALTQQVHVLSLDQIRAIRNTNEYTEGPTVVPRPGLKPAPRPSTQHKHERLHGLPEHRQPPRLQHSQVHSSARAPLSRSISTVSSGSRSSTRTSTSSSSSEQRLLGSSFSSGPVADGIIRVQPKSELKPGELKPLSKEDLGLHAYRCEDCGKCKCKECTYPRPLPSDWICDKQCLCSAQNVIDYGTCVCCVKGLFYHCSNDDEDNCADNPCSCSQSHCCTRWSAMGVMSLFLPCLWCYLPAKGCLKLCQGCYDRVNRPGCRCKNSNTVCCKVPTVPPRNFEKPT

SEQ ID NO: 65367 - protein, 315 aa, Homo sapiens; identical to SEQ ID NO: 65366

SEQ ID NO: 65368 - protein, 315 aa, Homo sapiens; identical to SEQ ID NO: 65366

SEQ ID NO: 65369 - protein, 353 aa, Homo sapiens
MEARAQSGNGSQPLLQTPRDGGRQRGEPDPRDALTQQVHVLSLDQIRAIRNTNEYTEGPTVVPRPGLKPAPRPSTQHKHERLHGLPEHRQPPRLQHSQVHSSARAPLSRSISTVSSGSRSSTRTSTSSSSSEQRLLGSSFSSGPVADGIIRVQPKSELKPGELKPLSKEDLGLHAYRCEDCGKCKCKECTYPRPLPSDWICDKQCLCSAQNVIDYGTCVCCVKGLFYHCSNDDEDNCADNPCSCSQSHCCTRWSAMGVMSLFLPCLWCYLPAKGCLKLCQGCYDRVNRPGCRCKNSNTVCCKVPTVPPRTLKNQHSIINQEYYSNEDFFFLFLIHICNQLNSYNLGTVNRKVG

SEQ ID NO: 65370 - protein, 288 aa, Homo sapiens
MDAAVTDDFQQILPIEQLRSTHASNDYVERPPAPCKQALSSPSLIVQTHKSDWSLATMPTSLPRSLSQCHQLQPLPQHLSQSSIASSMSHSTTASDQRLLASITPSPSGQSIIRTQPGAGVHPKADGALKGEAEQSAGHPSEHLFICEECGRCKCVPCTAARPLPSCWLCNQRCLCSAESLLDYGTCLCCVKGLFYHCSTDDEDNCADEPCSCGPSSCFVRWAAMSLISLFLPCLCCYLPTRGCLHLCQQGYDSLRRPGCRCKRHTNTVCRKISSGSAPFPKAQEKSV

SEQ ID NO: 65371 - protein, 125 aa, Homo sapiens
MDAAVTDDFQQILPIEQLRSTHASNDYVERPPAPCKQALSSPSLIVQTHKSDWSLATMPTSLPRSLSQCHQLQPLPQHLSQSSIASSMSHSTTASSTTAPLMMKTTVLMSPALVGLVLALSAGQP

SEQ ID NO: 65372 - protein, 322 aa, Homo sapiens
MLSPLPTGPLEACFSVQSRTSSPMEPPIPQSAPLTPNSVMVQPLLDSRMSHSRLQHPLTILPIDQVKTSHVENDYIDNPSLALTTGPKRTRGGAPELAPTPARCDQDVTHHWISFSGRPSSVSSSSSTSSDQRLLDHMAPPPVADQASPRAVRIQPKVVHCQPLDLKGPAVPPELDKHFLLCEACGKCKCKECASPRTLPSCWVCNQECLCSAQTLVNYGTCMCLVQGIFYHCTNEDDEGSCADHPCSCSRSNCCARWSFMGALSVVLPCLLCYLPATGCVKLAQRGYDRLRRPGCRCKHTNSVICKAASGDAKTSRPDKPF

SEQ ID NO: 65373 - protein, 106 aa, Homo sapiens
MEPPIPQSAPLTPNSVMVQPLLDSRMSHSRLQHPLTILPIDQVKTSHVENDYIDNPSLALTTGPKRTRGGAPELAPTPARCDQDVTHHWISFSGRPCSATCLPPAA

SEQ ID NO: 65374 - protein, 299 aa, Homo sapiens
MEPPIPQSAPLTPNSVMVQPLLDSRMSHSRLQHPLTILPIDQVKTSHVENDYIDNPSLALTTGPKRTRGGAPELAPTPARCDQDVTHHWISFSGRPSSVSSSSSTSSDQRLLDHMAPPPVADQASPRAVRIQPKVVHCQPLDLKGPAVPPELDKHFLLCEACGKCKCKECASPRTLPSCWVCNQECLCSAQTLVNYGTCMCLVQGIFYHCTNEDDEGSCADHPCSCSRSNCCARWSFMGALSVVLPCLLCYLPATGCVKLAQRGYDRLRRPGCRCKHTNSVICKAASGDAKTSRPDKPF

SEQ ID NO: 65375 - protein, 50 aa, Homo sapiens
MEPPIPQSAPLTPNSVMVQPLLDSRMSHSRLQHPLTILPIDQVKTSHVEN

SEQ ID NO: 65376 - protein, 444 aa, Homo sapiens
MSEETATSDNDNSYARVRAVVMTRDDSSGGWLPLGGSGLSSVTVFKVPHQEENGCADFFIRGERLRDKMVVLECMLKKDLIYNKVTPTFHHWKIDDKKFGLTFQSPADARAFDRGIRRAIEDISQGCPESKNEAEGADDLQANEEDSSSSLVKDHLFQQETVVTSEPYRSSNIRPSPFEDLNARRVYMQSQANQITFGQPGLDIQSRSMEYVQRQISKECGSLKSQNRVPLKSIRHVSFQDEDEIVRINPRDILIRRYADYRHPDMWKNDLERDDADSSIQFSKPDSKKSDYLYSCGDETKLSSPKDSVVFKTQPSSLKIKKSKRRKEDGERSRCVYCQERFNHEENVRGKCQDAPDPIKRCIYQVSCMLCAESMLYHCMSDSEGDFSDPCSCDTSDDKFCLRWLALVALSFIVPCMCCYVPLRMCHRCGEACGCCGGKHKAAG

SEQ ID NO: 65377 - protein, 418 aa, Homo sapiens
MTEETHPDDDSYIVRVKAVVMTRDDSSGGWFPQEGGGISRVGVCKVMHPEGNGRSGFLIHGERQKDKLVVLECYVRKDLVYTKANPTFHHWKVDNRKFGLTFQSPADARAFDRGVRKAIEDLIEGSTTSSSTIHNEAELGDDDVFTTATDSSSNSSQKREQPTRTISSPTSCEHRRIYTLGHLHDSYPTDHYHLDQPMPRPYRQVSFPDDDEEIVRINPREKIWMTGYEDYRHAPVRGKYPDPSEDADSSYVRFAKGEVPKHDYNYPYVDSSDFGLGEDPKGRGGSVIKTQPSRGKSRRRKEDGERSRCVYCRDMFNHEENRRGHCQDAPDSVRTCIRRVSCMWCADSMLYHCMSDPEGDYTDPCSCDTSDEKFCLRWMALIALSFLAPCMCCYLPLRACYHCGVMCRCCGGKHKAAA

SEQ ID NO: 65378 - protein, 116 aa, Homo sapiens
MTEETHPDDDSYIVRVKAVVMTRDDSSGGWFPQEGGGISRVGVCKVMHPEGNGRSGFLIHGERQKDKLVVLECYVRKDLVYTKANPTFHHWKVDNRKFGLTFQSPADARAFDRGVR

SEQ ID NO: 65379 - protein, 415 aa, Homo sapiens
MASPGSDSYIVRVKAVVMTRDDSSGGWFPQEGGGISRVGVCKVMHPEGNGRSGFLIHGERQKDKLVVLECYVRKDLVYTKANPTFHHWKVDNRKFGLTFQSPADARAFDRGVRKAIEDLIEGSTTSSSTIHNEAELGDDDVFTTATDSSSNSSQKREQPTRTISSPTSCEHRRIYTLGHLHDSYPTDHYHLDQPMPRPYRQVSFPDDDEEIVRINPREKIWMTGYEDYRHAPVRGKYPDPSEDADSSYVRFAKGEVPKHDYNYPYVDSSDFGLGEDPKGRGGSVIKTQPSRGKSRRRKEDGERSRCVYCRDMFNHEENRRGHCQDAPDSVRTCIRRVSCMWCADSMLYHCMSDPEGDYTDPCSCDTSDEKFCLRWMALIALSFLAPCMCCYLPLRACYHCGVMCRCCGGKHKAAA

SEQ ID NO: 65380 - protein, 410 aa, Homo sapiens
MVRVRAVVMARDDSSGGWLPVGGGGLSQVSVCRVRGARPEGGARQGHYVIHGERLRDQKTTLECTLKPGLVYNKVNPIFHHWSLGDCKFGLTFQSPAEADEFQKSLLAALAALGRGSLTPSSSSSSSSPSQDTAETPCPLTSHVDSDSSSSHSRQETPPSAAAAPIITMESASGFGPTTPPQRRRSSAQSYPPLLPFTGIPEPSEPLAGAGGLGWGGRGYEDYRRSGPPAPLALSTCVVRFAKTGALRGAALGPPAALPAPLTEAAPPAPPARPPPGPGPSSAPAKASPEAEEAARCVHCRALFRRRADGRGGRCAEAPDPGRLLVRRLSCLWCAESLLYHCLSDAEGDFSDPCACEPGHPRPAARWAALAALSLAVPCLCCYAPLRACHWVAARCGCAGCGGRHEEAAR

SEQ ID NO: 65381 - protein, 152 aa, Homo sapiens
MVRVRAVVMARDDSSGGWLPVGGGGLSQVSVCRVRGARPEGGARQGHYVIHGERLRDQKTTLECTLKPGLVYNKVNPIFHHWSLGDCKFGLTFQSPAEADEFQKSLLAALAALGRGSLTPSSSSSSSSPSQDTAETPCPLTLSQYFRHMLCP

SEQ ID NO: 65382 - protein, 574 aa, Homo sapiens
MWTFLGIATFTYFYKKFGDFITLANREVLLCVLVFLSLGLVLSYRCRHRNGGLLGRQQSGSQFALFSDILSGLPFIGFFWAKSPPESENKEQLEARRRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPNAKFIEGVVLQLLEEDDVVMGVQYKDKETGDIKELHAPLTVVADGLFSKFRKSLVSNKVSVSSHFVGFLMKNAPQFKANHAELILANPSPVLIYQISSSETRVLVDIRGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEAKKSFYWARKTSHSFVVNILAQALYELFSATDDSLHQLRKACFLYFKLGGECVAGPVGLLSVLSPNPLVLIGHFFAVAIYAVYFCFKSEPWITKPRALLSSGAVLYKACSVIFPLIYSEMKYMVH

SEQ ID NO: 65383 - protein, 479 aa, Homo sapiens
MLRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPNAKFIEGVVLQLLEEDDVVMGVQYKDKETGDIKELHAPLTVVADGLFSKFRKSLVSNKVSVSSHFVGFLMKNAPQFKANHAELILANPSPVLIYQISSSETRVLVDIRGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEAKKSFYWARKTSHSFVVNILAQALYELFSATDDSLHQLRKACFLYFKLGGECVAGPVGLLSVLSPNPLVLIGHFFAVAIYAVYFCFKSEPWITKPRALLSSGAVLYKACSVIFPLIYSEMKYMVH

SEQ ID NO: 65384 - protein, 379 aa, Homo sapiens
MIHDQESKSEVQIPYPLSENNQVQSGRAFHHGRFIMSLRKAAMAEPNAKFIEGVVLQLLEEDDVVMGVQYKDKETGDIKELHAPLTVVADGLFSKFRKSLVSNKVSVSSHFVGFLMKNAPQFKANHAELILANPSPVLIYQISSSETRVLVDIRGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEAKKSFYWARKTSHSFVVNILAQALYELFSATDDSLHQLRKACFLYFKLGGECVAGPVGLLSVLSPNPLVLIGHFFAVAIYAVYFCFKSEPWITKPRALLSSGAVLYKACSVIFPLIYSEMKYMVH

SEQ ID NO: 65385 - protein, 963 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISVTFEKALNAGFIQATDYVEIWQAYLDYLRRRVDFKQDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 65386 - protein, 699 aa, Homo sapiens
MRLRRLGQGGRCYRGLWPLRHTRPWSSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISVTFEKALNAGFIQATDYVEIWQAYLDYLRRRVDFKQDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEAFQTQKGREQHPCSWRNTKCRSSSRARWEMCCRRCGAPFEAEGEGSLPEEGHAQGAARQQQGQHHRLCQQPALQHAGAGHEAQATLRGLWGGGPDPTHLQQPWGFPRLLLRGV

SEQ ID NO: 65387 - protein, 927 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 65388 - protein, 528 aa, Homo sapiens
MERHGVDHQVISDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 65389 - protein, 129 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQVGPGVGSGHLPVFQVLGSPCPGPPP

SEQ ID NO: 65390 - protein, 109 aa, Homo sapiens
MAASAARGAAALRRSINQPVAFVRRIPWTAASSQLKEHFAQFGHVRRCILPFDKETGFHRGLGWVQFSSEEGLRNALQQENHIIDGVKVQVHTRRPKLPQTSDDEKKDF

SEQ ID NO: 65391 - protein, 297 aa, Homo sapiens
MAKWLNKYFSLGNSKTKSPPQPPRPDYREQRRRGERPSQPPQAVPQASSAASASCGPATASCFSASSGSLPDDSGSTSDLIRAYRAQKERDFEDPYNGPGSSLRKLRAMCRLDYCGGSGEPGGVQRAFSASSASGAAGCCCASSGAGAAASSSSSSGSPHLYRSSSERRPATPAEVRYISPKHRLIKVESAAGGGAGDPLGGACAGGRTWSPTACGGKKLLNKCAASAAEESGAGKKDKVTIADDYSDPFDAKNDLKSKAGKGESAGYMEPYEAQRIMTGLQEAWRHSPSGCFPVGP

SEQ ID NO: 65392 - protein, 509 aa, Homo sapiens
MAKWLNKYFSLGNSKTKSPPQPPRPDYREQRRRGERPSQPPQAVPQASSAASASCGPATASCFSASSGSLPDDSGSTSDLIRAYRAQKERDFEDPYNGPGSSLRKLRAMCRLDYCGGSGEPGGVQRAFSASSASGAAGCCCASSGAGAAASSSSSSGSPHLYRSSSERRPATPAEVRYISPKHRLIKVESAAGGGAGDPLGGACAGGRTWSPTACGGKKLLNKCAASAAEESGAGKKDKVTIADDYSDPFDAKNDLKSKAGKGESAGYMEPYEAQRIMTEFQRQESVRSQHKGIQLYDTPYEPEGQSVDSDSESTVSPRLRESKLPQDDDRPADEYDQPWEWNRVTIPALAAQFNGNEKRQSSPSPSRDRRRQLRAPGGGFKPIKHGSPEFCGILGERVDPAVPLEKQIWYHGAISRGDAENLLRLCKECSYLVRNSQTSKHDYSLSLRSNQGFMHMKLAKTKEKYVLGQNSPPFDSVPEVIHYYTTRKLPIKGAEHLSLLYPVAVRTL

SEQ ID NO: 65393 - protein, 359 aa, Homo sapiens
MQAAALPEEIRWLLEDAEEFLAEGLRNENLSAVARDHRDHILRGFQQIKARYYWDFQPQGGDIGQDSSDDNHSGTLGLSLTSDAPFLSDYQDEGMEDIVKGAQELDNVIKQGYLEKKSKDHSFFGSEWQKRWCVVSRGLFYYYANEKSKQPKGTFLIKGYGVRMAPHLRRDSKKESCFELTSQDRRSYEFTATSPAEARDWVDQISFLLKDLSSLTIPYEEDEEEEEKEETYDDIDGFDSPSCGSQCRPTILPGSVGIKEPTEEKEEEDIYEVLPDEEHDLEEDESGTRRKGVDYASYYQGLWDCHGDQPDELSFQRGDLIRILSKEYNMYGWWVGELNSLVGIVPKEYLTTAFEVEER

SEQ ID NO: 65394 - protein, 276 aa, Homo sapiens
MGNSMKSTPAPAERPLPNPEGLDSDFLAVLSDYPSPDISPPIFRRGEKLRVISDEGGWWKAISLSTGRESYIPGICVARVYHGWLFEGLGRDKAEELLQLPDTKVGSFMIRESETKKGFYSLSVRHRQVKHYRIFRLPNNWYYISPRLTFQCLEDLVNHYSEVADGLCCVLTTPCLTQSTAAPAVRASSSPVTLRQKTVDWRRVSRLQEDPEGTENPLGVDESLFSYGLRESIASYLSLTSEDNTSFDRKKKSISLMYGGSKRKSSFFSSPPYFED

SEQ ID NO: 65395 - protein, 293 aa, Homo sapiens
MLHRLWASPAAPGKKKEMGNSMKSTPAPAERPLPNPEGLDSDFLAVLSDYPSPDISPPIFRRGEKLRVISDEGGWWKAISLSTGRESYIPGICVARVYHGWLFEGLGRDKAEELLQLPDTKVGSFMIRESETKKGFYSLSVRHRQVKHYRIFRLPNNWYYISPRLTFQCLEDLVNHYSEVADGLCCVLTTPCLTQSTAAPAVRASSSPVTLRQKTVDWRRVSRLQEDPEGTENPLGVDESLFSYGLRESIASYLSLTSEDNTSFDRKKKSISLMYGGSKRKSSFFSSPPYFED

SEQ ID NO: 65396 - protein, 316 aa, Homo sapiens
MLSKLGHSPLGGLRARLTFPVCLLYHRLWASPAAPGKKKEMGNSMKSTPAPAERPLPNPEGLDSDFLAVLSDYPSPDISPPIFRRGEKLRVISDEGGWWKAISLSTGRESYIPGICVARVYHGWLFEGLGRDKAEELLQLPDTKVGSFMIRESETKKGFYSLSVRHRQVKHYRIFRLPNNWYYISPRLTFQCLEDLVNHYSEVADGLCCVLTTPCLTQSTAAPAVRASSSPVTLRQKTVDWRRVSRLQEDPEGTENPLGVDESLFSYGLRESIASYLSLTSEDNTSFDRKKKSISLMYGGSKRKSSFFSSPPYFED

SEQ ID NO: 65397 - protein, 91 aa, Homo sapiens
MGNSMKSTPAPAERPLPNPEGLDSDFLAVLSDYPSPDISPPIFRRGEKLRVISDEGGWWKAISLSTGRESYIPGICVARVYHGWLFEGLGR

SEQ ID NO: 65398 - protein, 14 aa, Homo sapiens
MGNSMKSTPAPAER

SEQ ID NO: 65399 - protein, 49 aa, Homo sapiens
MGNSMKSTPAPAERPLPNPEGLDSDFLAVLSDYPSPDISPPIFRRGEKL

SEQ ID NO: 65400 - protein, 158 aa, Homo sapiens
MGNSMKSTPAPAERPLPNPEGLDSDFLAVLSDYPSPDISPPIFRRGEKLRVISDEGGWWKAISLSTGRESYIPGICVARVYHGWLFEGLGRDKAEELLQLPDTKVGSFMIRESETKKGFYSLSVRHRQVKHYRIFRLPNNWYYISPRLTFQCLEDLVN

SEQ ID NO: 65401 - protein, 40 aa, Homo sapiens
MGNSMKSTPAPAERPLPNPEGLDSDFLAVLSDYPSPDISP

SEQ ID NO: 65402 - protein, 261 aa, Homo sapiens
MGSLPSRRKSLPSPSLSSSVQGQGPVTMEAERSKATAVALGSFPAGGPAELSLRLGEPLTIVSEDGDWWTVLSEVSGREYNIPSVHVAKVSHGWLYEGLSREKAEELLLLPGNPGGAFLIRESQTRRGSYSLSVRLSRPASWDRIRHYRIHCLDNGWLYISPRLTFPSLQALVDHYSELADDICCLLKEPCVLQRAGPLPGKDIPLPVTVQRTPLNWKELDSSLLFSEAATGEESLLSEGLRESLSFYISLNDEAVSLDDA

SEQ ID NO: 65403 - protein, 210 aa, Homo sapiens
MGSLPSRRKSLPSPSLSSSVQGQGPVTMEAERSKATAVALGSFPAGGPAELSLRLGEPLTIVSEDGDWWTVLSEVSGREYNIPSVHVAKVSHGWLYEGLSREKAEELLLLPGNPGGAFLIRESQTRRGSYSLSVRLSRPASWDRIRHYRIHCLDNGWLYISPRLTFPSLQALVDHYSEGWPAPWQGYTPTCDCAEDTTQLERAGQLPPVF

SEQ ID NO: 65404 - protein, 1279 aa, Homo sapiens
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSVFPWHKNLLAVDVFRSPLSRAFQLVEEIRNHVLRDSSGIRSLEELCLQVTDLLPGLRKLRNLLPEHGCLLLSPGNFWQNDWERFHADPDIIGTIHQHEPKTLQTSATLKDLLFGVPGKYSGVSLYTRKRMVSYTITLVFQHYHAKFLGSLRARLMLLHPSPNCSLRAESLVHVHFKEEIGVAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAALGLATGIVLVLLLLCLYRVLCPRNYGQLGGGPGRRRRGELPCDDYGYAPPETEIVPLVLRGHLMDIECLASDGMLLVSCCLAGHVCVWDAQTGDCLTRIPRPGRQRRDSGVGSGLEAQESWERLSDGGKAGPEEPGDSPPLRHRPRGPPPPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKPITALKAAAGRLVTGSQDHTLRVFRLEDSCCLFTLQGHSGAITTVYIDQTMVLASGGQDGAICLWDVLTGSRVSHVFAHRGDVTSLTCTTSCVISSGLDDLISIWDRSTGIKFYSIQQDLGCGASLGVISDNLLVTGGQGCVSFWDLNYGDLLQTVYLGKNSEAQPARQILVLDNAAIVCNFGSELSLVYVPSVLEKLD

SEQ ID NO: 65405 - protein, 771 aa, Homo sapiens
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSVFPWHKNLLAVDVFRSPLSRAFQLVEEIRNHVLRDSSGIRSLEELCLQVTDLLPGLRKLRNLLPEHGCLLLSPGNFWQNDWERFHADPDIIGTIHQHEPKTLQTSATLKDLLFGVPGKYSGVSLYTRKRMVSYTITLVFQHYHAKFLGSLRARLMLLHPSPNCSLRAESLVHVHFKEEIGVAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNMATELGIILIGYFTLVPAIQEFCLFAVVGLVSDFFLQMLFFTTVLSIDIRRMELADLNKRLPPEACLPSAKPVGQPTRYERSSGRLEVWDAIEGVLCCSSEEVSSGITALVFLDKRIVAARLNGSLDFFSLETHTALSPLQFRGTPGRGSSPASPVYSSSDTVACHLTHTVPCAHQKPITALKAAAGRLVTGSQDHTLRVFRLEDSCCLFTLQGHSGAITTVYIDQTMVLASGGQDGAICLWDVLTGSRVSHVFAHRGDVTSLTCTTSCVISSGLDDLISIWDRSTGIKFYSIQQDLGCGASLGVISDNLLVTGGQGCVSFWDLNYGDLLQTVYLGKNSEAQPARQILVLDNAAIVCNFGSELSLVYVPSVLEKLD

SEQ ID NO: 65406 - protein, 905 aa, Homo sapiens
MTLTERLREKISRAFYNHGLLCASYPIPIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAALGLATGIVLVLLLLCLYRVLCPRNYGQLGGGPGRRRRGELPCDDYGYAPPETEIVPLVLRGHLMDIECLASDGMLLVSCCLAGHVCVWDAQTGDCLTRIPRPGQRRDSGVGSGLEAQESWERLSDGGKAGPEEPGDSPPLRHRPRGPPPPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKPITALKAAAGRLVTGSQDHTLRVFRLEDSCCLFTLQGHSGAITTVYIDQTMVLASGGQDGAICLWDVLTGSRVSHVFAHRGDVTSLTCTTSCVISSGLDDLISIWDRSTGIKFYSIQQDLGCGASLGVISDNLLVTGGQGCVSFWDLNYGDLLQTVYLGKNSEAQPARQILVLDNAAIVCNFGSELSLVYVPSVLEKLD

SEQ ID NO: 65407 - protein, 352 aa, Homo sapiens
MVKSKWGLALAAVVTVLSSLLMSVGLCTLFGLTPTLNGGEIFPYLVVVIGLENVLVLTKSVVSTPVDLEVKLRIAQGLSSESWSIMKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLAPTGAHTCWALGSRTQGPRWGAGPWRRHAVQGGGAGPGHRHRLGAAAALPLPRAMPAQLRAAGWWARAAEARGAALRRLRLCATRDGDRAACAARPPHGHRVPGQRRHAAGELLPGRPRLRVGRADRGLPNAHSAPRQAAPGQWRGQRA

SEQ ID NO: 65408 - protein, 136 aa, Homo sapiens
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSVFPWHKNLLAVDVFRSPLSRAFQLVEEIRNHVLRD

SEQ ID NO: 65409 - protein, 1023 aa, Homo sapiens
MLLHPSPNCSLRAESLVHVHFKEEIGVAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAALGLATGIVLVLLLLCLYRVLCPRNYGQLGGGPGRRRRGELPCDDYGYAPPETEIVPLVLRGHLMDIECLASDGMLLVSCCLAGHVCVWDAQTGDCLTRIPRPGQRRDSGVGSGLEAQESWERLSDGGKAGPEEPGDSPPLRHRPRGPPPPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKPITALKAAAGRLVTGSQDHTLRVFRLEDSCCLFTLQGHSGAITTVYIDQTMVLASGGQDGAICLWDVLTGSRVSHVFAHRGDVTSLTCTTSCVISSGLDDLISIWDRSTGIKFYSIQQDLGCGASLGVISDNLLVTGGQGCVSFWDLNYGDLLQTVYLGKNSEAQPARQILVLDNAAIVCNFGSELSLVYVPSVLEKLD

SEQ ID NO: 65410 - protein, 88 aa, Homo sapiens
MTLTERLREKISRAFYNHGLLCASYPIPIILFTGFCILACCYPLLKLPLPGTGPVEFTTPVKDYSPPPVDSDRKQGEPTEQPEWVGTR

SEQ ID NO: 65411 - protein, 132 aa, Homo sapiens
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSVFPWHKNLLAVDVFRSPLSRAFQLVEEIRNH

SEQ ID NO: 65412 - protein, 886 aa, Homo sapiens
MKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAALGLATGIVLVLLLLCLYRVLCPRNYGQLGGGPGRRRRGELPCDDYGYAPPETEIVPLVLRGHLMDIECLASDGMLLVSCCLAGHVCVWDAQTGDCLTRIPRPGQRRDSGVGSGLEAQESWERLSDGGKAGPEEPGDSPPLRHRPRGPPPPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKPITALKAAAGRLVTGSQDHTLRVFRLEDSCCLFTLQGHSGAITTVYIDQTMVLASGGQDGAICLWDVLTGSRVSHVFAHRGDVTSLTCTTSCVISSGLDDLISIWDRSTGIKFYSIQQDLGCGASLGVISDNLLVTGGQGCVSFWDLNYGDLLQTVYLGKNSEAQPARQILVLDNAAIVCNFGSELSLVYVPSVLEKLD

SEQ ID NO: 65413 - protein, 339 aa, Homo sapiens
MAAAAAAALESWQAAAPRKRRSAARRPRRREAAPRGREAAPRGREAAPRGPEAEFESDSGVVLRRIWEAEKDLFISDFWSSALETINRCLTKHLEQLKAPVGTLSDIFGNLHLDSLPEESDVATDSIPREILVTGTCHLKCVCYGIGNFATCIVARNQLTFLLLLLEKCQIPRSHCWVYDPLFSQLEIEVLNTLGVTVLSENEEGKRSIRGEPTIFYMLHCGTALYNNLLWSNWSVDALSKMVIIGNSFKGLEERLLARILQKNYPYIAKILKGLEELEFPQTSQYMDIFNDTSVHWFPVQKLEQLSIDIWEFREEPDYQDCEDLEIIRNKREDPSATD

SEQ ID NO: 65414 - protein, 391 aa, Homo sapiens
MYSMMMETDLHSPGGAQAPTNLSGPAGAGGGGGGGGGGGGGGGAKANQDRVKRPMNAFMVWSRGQRRKMAQENPKMHNSEISKRLGAEWKVMSEAEKRPFIDEAKRLRALHMKEHPDYKYRPRRKTKTLLKKDKYSLAGGLLAAGAGGGGAAVAMGVGVGVGAAAVGQRLESPGGAAGGGYAHVNGWANGAYPGSVAAAAAAAAMMQEAQLAYGQHPGAGGAHPHAHPAHPHPHHPHAHPHNPQPMHRYDMGALQYSPISNSQGYMSASPSGYGGLPYGAAAAAAAAAGGAHQNSAVAAAAAAAAASSGALGALGSLVKSEPSGSPPAPAHSRAPCPGDLREMISMYLPAGEGGDPAAAAAAAAQSRLHSLPQHYQGAGAGVNGTVPLTHI

SEQ ID NO: 65415 - protein, 441 aa, Homo sapiens
MVQQAESLEAESNLPREALDTEEGEFMACSPVALDESDPDWCKTASGHIKRPMNAFMVWSKIERRKIMEQSPDMHNAEISKRLGKRWKMLKDSEKIPFIREAERLRLKHMADYPDYKYRPRKKPKMDPSAKPSASQSPEKSAAGGGGGSAGGGAGGAKTSKGSSKKCGKLKAPAAAGAKAGAGKAAQSGDYGGAGDDYVLGSLRVSGSGGGGAGKTVKCVFLDEDDDDDDDDDELQLQIKQEPDEEDEEPPHQQLLQPPGQQPSQLLRRYNVAKVPASPTLSSSAESPEGASLYDEVRAGATSGAGGGSRLYYSFKNITKQHPPPLAQPALSPASSRSVSTSSSSSSGSSSGSSGEDADDLMFDLSLNFSQSAHSASEQQLGGGAAAGNLSLSLVDKDLDSFSEGSLGSHFEFPDYCTPELSEMIAGDWLEANFSDLVFTY

SEQ ID NO: 65416 - protein, 315 aa, Homo sapiens
MVQQRGARAKRDGGPPPPGPGPAEEGAREPGWCKTPSGHIKRPMNAFMVWSQHERRKIMDQWPDMHNAEISKRLGRRWQLLQDSEKIPFVREAERLRLKHMADYPDYKYRPRKKSKGAPAKARPRPPGGSGGGSRLKPGPQLPGRGGRRAAGGPLGGGAAAPEDDDEDDDEELLEVRLVETPGRELWRMVPAGRAARGQAERAQGPSGEGAAAAAAASPTPSEDEEPEEEEEEAAAAEEGEEETVASGEESLGFLSRLPPGPAGLDCSALDRDPDLQPPSGTSHFEFPDYCTPEVTEMIAGDWRPSSIADLVFTY

SEQ ID NO: 65417 - protein, 315 aa, Homo sapiens; identical to SEQ ID NO: 65416

SEQ ID NO: 65418 - protein, 622 aa, Homo sapiens
MSMRSPISAQLALDGVGTMVNCTIKSEEKKEPCHEAPQGSATAAEPQPGDPARASQDSADPQAPAQGNFRGSWDCSSPEGNGSPEPKRPGVSEAASGSQEKLDFNRNLKEVVPAIEKLLSSDWKERFLGRNSMEAKDVKGTQESLAEKELQLLVMIHQLSTLRDQLLTAHSEQKNMAAMLFEKQQQQMELARQQQEQIAKQQQQLIQQQHKINLLQQQIQQVNMPYVMIPAFPPSHQPLPVTPDSQLALPIQPIPCKPVEYPLQLLHSPPAPVVKRPGAMATHHPLQEPSQPLNLTAKPKAPELPNTSSSPSLKMSSCVPRPPSHGGPTRDLQSSPPSLPLGFLGEGDAVTKAIQDARQLLHSHSGALDGSPNTPFRKDLISLDSSPAKERLEDGCVHPLEEAMLSCDMDGSRHFPESRNSSHIKRPMNAFMVWAKDERRKILQAFPDMHNSSISKILGSRWKSMTNQEKQPYYEEQARLSRQHLEKYPDYKYKPRPKRTCIVEGKRLRVGEYKALMRTRRQDARQSYVIPPQAGQVQMSSSDVLYPRAAGMPLAQPLVEHYVPRSLDPNMPVIVNTCSLREEGEGTDDRHSVADGEMYRYSEDEDSEGEEKSDGELVVLTD

SEQ ID NO: 65419 - protein, 57 aa, Homo sapiens
MSMRSPISAQLALDGVGTMVNCTIKSEEKKEPCHEAPQGSATAAEPQPGDPARASQD

SEQ ID NO: 65420 - protein, 180 aa, Homo sapiens
MSMRSPISAQLALDGVGTMVNCTIKSEEKKEPCHEAPQGSATAAEPQPGDPARASQDSADPQAPAQGNFRGSWDCSSPEGNGSPEPKRPGVSEAASGSQEKLDFNRNLKEVVPAIEKLLSSDWKERFLGRNSMEAKDVKGTQESLAEKELQLLVMIHQLSTLRDQLLTAHSEQKNMAAML

SEQ ID NO: 65421 - protein, 240 aa, Homo sapiens
MSKPSDHIKRPMNAFMVWSRGQRRKMAQENPKMHNSEISKRLGAEWKLLSEAEKRPYIDEAKRLRAQHMKEHPDYKYRPRRKPKNLLKKDRYVFPLPYLGDTDPLKAAGLPVGASDGLLSAPEKARAFLPPASAPYSLLDPAQFSSSAIQKMGEVPHTLATGALPYASTLGYQNGAFGSLSCPSQHTHTHPSPTNPGYVVPCNCTAWSASTLQPPVAYILFPGMTKTGIDPYSSAHATAM

SEQ ID NO: 65422 - protein, 233 aa, Homo sapiens [sequence omitted]

SEQ ID NO: 65423 - protein, 233 aa, Homo sapiens [sequence omitted]

SEQ ID NO: 65424 - protein, 414 aa, Homo sapiens [sequence omitted]

SEQ ID NO: 65425 - protein, 384 aa, Homo sapiens [sequence omitted]

SEQ ID NO: 65426 - protein, 276 aa, Homo sapiens
MSKPVDHVKRPMNAFMVWSRAQRRKMAQENPKMHNSEISKRLGAEWKLLTESEKRPFIDEAKRLRAMHMKEHPDYKYRPRRKPKTLLKKDKFAFPVPYGLGGVADAEHPALKAGAGLHAGAGGGLVPESLLANPEKAAAAAAAAAARVFFPQSAAAAAAAAAAAAAGSPYSLLDLGSKMAEISSSSSGLPYASSLGYPTAGAGAFHGAAAAAAAAAAAAGGHTHSHPSPGNPGYMIPCNCSAWPSPGLQPPLAYILLPGMGKPQLDPYPAAYAAAL

SEQ ID NO: 65427 - protein, 446 aa, Homo sapiens
MRPVRENSSGARSPRVPADLARSILISLPFPPDSLAHRPPSSAPTESQGLFTVAAPAPGAPSPPATLAHLLPAPAMYSLLETELKNPVGTPTQAAGTGGPAAPGGAGKSSANAAGGANSGGGSSGGASGGGGGTDQDRVKRPMNAFMVWSRGQRRKMALENPKMHNSEISKRLGADWKLLTDAEKRPFIDEAKRLRAVHMKEYPDYKYRPRRKTKTLLKKDKYSLPSGLLPPGAAAAAAAAAAAAAAASSPVGVGQRLDTYTHVNGWANGAYSLVQEQLGYAQPPSMSSPPPPPALPPMHRYDMAGLQYSPMMPPGAQSYMNVAAAAAAASGYGGMAPSATAAAAAAYGQQPATAAAAAAAAAAMSLGPMGSVVKSEPSSPPPAIASHSQRACLGDLRDMISMYLPPGGDAADAASPLPGGRLHGVHQHYQGAGTAVNGTVPLTHI

SEQ ID NO: 65428 - protein, 750 aa, Homo sapiens
MSSKRPASPYGEADGEVAMVTSRQKVEEEESDGLPAFHLPLHVSFPNKPHSEEFQPVSLLTQETCGHRTPTSQHNTMEVDGNKVMSSFAPHNSSTSPQKAEEGGRQSGESLSSTALGTPERRKGSLADVVDTLKQRKMEELIKNEPEETPSIEKLLSKDWKDKLLAMGSGNFGEIKGTPESLAEKERQLMGMINQLTSLREQLLAAHDEQKKLAASQIEKQRQQMELAKQQQEQIARQQQQLLQQQHKINLLQQQIQVQGQLPPLMIPVFPPDQRTLAAAAQQGFLLPPGFSYKAGCSDPYPVQLIPTTMAAAAAATPGLGPLQLQQLYAAQLAAMQVSPGGKLPGIPQGNLGAAVSPTSIHTDKSTNSPPPKSKDEVAQPLNLSAKPKTSDGKSPTSPTSPHMPALRINSGAGPLKASVPAALASPSARVSTIGYLNDHDAVTKAIQEARQMKEQLRREQQVLDGKVAVVNSLGLNNCRTEKEKTTLESLTQQLAVKQNEEGKFSHAMMDFNLSGDSDGSAGVSESRIYRESRGRGSNEPHIKRPMNAFMVWAKDERRKILQAFPDMHNSNISKILGSRWKAMTNLEKQPYYEEQARLSKQHLEKYPDYKYKPRPKRTCLVDGKKLRIGEYKAIMRNRRQEMRQYFNVGQQAQIPIATAGVVYPGAIAMAGMPSPHLPSEHSSVSSSPEPGMPVIQSTYGVKGEEPHIKEEIQAEDINGEIYDEYDEEEDDPDVDYGSDSENHIAGQAN

SEQ ID NO: 65429 - protein, 642 aa, Homo sapiens
MSSKRPASPYGEADGEVAMVTSRQKVEEEESDGLPAFHLPLHVSFPNKPHSEEFQPVSLLTQETCGHRTPTSQHNTMEVDGNKVMSSFAPHNSSTSPQKAEEGGRQSGESLSSTALGTPERRKGSLADVVDTLKQRKMEELIKNEPEETPSIEKLLSKDWKDKLLAMGSGNFGEIKGTPESLAEKERQLMGMINQLTSLREQLLAAHDEQKKLAASQIEKQRQQMELAKQQQEQIARQQQQLLQQQHKINLLQQQIQVQGQLPPLMIPVFPPDQRTLAAAAQQGFLLPPGFSYKAGCSDPYPVQLIPTTMAAAAAATPGLGPLQLQQLYAAQLAAMQVSPGGKLPGIPQGNLGAAVSPTSIHTDKSTNSPPPKSKEKTTLESLTQQLAVKQNEEGKFSHAMMDFNLSGDSDGSAGVSESRIYRESRGRGSNEPHIKRPMNAFMVWAKDERRKILQAFPDMHNSNISKILGSRWKAMTNLEKQPYYEEQARLSKQHLEKYPDYKYKPRPKRTCLVDGKKLRIGEYKAIMRNRRQEMRQYFNVGQQAQIPIATAGVVYPGAIAMAGMPSPHLPSEHSSVSSSPEPGMPVIQSTYGVKGEEPHIKEEIQAEDINGEIYDEYDEEEDDPDVDYGSDSENHIAGQAN

SEQ ID NO: 65430 - protein, 377 aa, Homo sapiens
MHDEVAQPLNLSAKPKTSDGKSPTSPTSPHMPALRINSGAGPLKASVPAALASPSARVSTIGYLNDHDAVTKAIQEARQMKEQLRREQQVLDGKVAVVNSLGLNNCRTEKEKTTLESLTQQLAVKQNEEGKFSHAMMDFNLSGDSDGSAGVSESRIYRESRGRGSNEPHIKRPMNAFMVWAKDERRKILQAFPDMHNSNISKILGSRWKAMTNLEKQPYYEEQARLSKQHLEKYPDYKYKPRPKRTCLVDGKKLRIGEYKAIMRNRRQEMRQYFNVGQQAQIPIATAGVVYPGAIAMAGMPSPHLPSEHSSVSSSPEPGMPVIQSTYGVKGEEPHIKEEIQAEDINGEIYDEYDEEEDDPDVDYGSDSENHIAGQAN

SEQ ID NO: 65431 - protein, 587 aa, Homo sapiens
MSSKRPASPYGEADGEVAMVTSRQKVEEEESDGLPAFHLPLHEVDGNKVMSSFAPHNSSTSPQKAEEGGRQSGESLSSTALGTPERRKGSLADVVDTLKQRKMEELIKNEPEETPSIEKLLSKDWKDKLLAMGSGNFGEIKGTPESLAEKERQLMGMINQLTSLREQLLAAHDEQKKLAASQIEKQRQQMELAKQQQEQIARQQQQLLQQQHKINLLQQQIQVQGQLPPLMIPVFPPDQRTLAAAAQQGFLLPPGFSYKAGCSDPYPVQLIPTTMAAAAAATPGLGPLQLQQLYAAQLAAMQVSPGGKLPGIPQGNLGAAVSPTSIHTDKSTNSPPPKSKDEVAQPLNLSAKPKTSDGKSPTSPTSPHMPALRINSGAGPLKASVPAALASPSARVSTIGYLNDHDAVTKAIQEARQMKEQLRREQQVLDGKVAVVNSLGLNNCRTEKEKTTLESLTQQLAVKQNEEGKFSHAMMDFNLSGDSDGSAGVSESRIYRESRGRGSNEPHIKRPMNAFMVWAKDERRKILQAFPDLGFLCVCMYVIMVLIIGITLDHCELNPHLGMKSHILPSDWSRNNLDLDFALQMTT

SEQ ID NO: 65432 - protein, 763 aa, Homo sapiens [sequence omitted]

SEQ ID NO: 65433 - protein, 642 aa, Homo sapiens; identical to SEQ ID NO: 65429

SEQ ID NO: 65434 - protein, 750 aa, Homo sapiens; identical to SEQ ID NO: 65428

SEQ ID NO: 65435 - protein, 808 aa, Homo sapiens
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQKGHVSHPQINQRLKGLSDRFGRNLDTFEHGGGHSYNHKQIEQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 65436 - protein, 828 aa, Homo sapiens
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQKGHVSHPQINQRLKGLSDRFGRNLDTFEHGGGHSYNHKQIEQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGSKAMNGSAAKLQQYYCWPTGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 65437 - protein, 808 aa, Homo sapiens; identical to SEQ ID NO: 65435

SEQ ID NO: 65438 - protein, 139 aa, Homo sapiens
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKL

SEQ ID NO: 65439 - protein, 801 aa, Homo sapiens
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLGKWKSQHQEETYELDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGSKAMNGSAAKLQQYYCWPTGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 65440 - protein, 828 aa, Homo sapiens; identical to SEQ ID NO: 65436

SEQ ID NO: 65441 - protein, 79 aa, Homo sapiens
MSSKQATSPFACAADGEDAMTQDLTSREKEEGSDQHVASHLPLHPIMHNKPHSEELPTLVSTIQQDADWDSVLSSQQRM

SEQ ID NO: 65442 - protein, 159 aa, Homo sapiens
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSK

SEQ ID NO: 65443 - protein, 804 aa, Homo sapiens
MGRMSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLGKWKSQHQEETYELDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGSKAMNGSAAKLQQYYCWPTGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 65444 - protein, 388 aa, Homo sapiens [sequence omitted]

SEQ ID NO: 65445 - protein, 440 aa, Homo sapiens
MSMLAERRRKQKWAVDPQNTAWSNDDSKFGQRMLEKMGWSKGKGLGAQEQGATDHIKVQVKNNHLGLGATINNEDNWIAHQDDFNQLLAELNTCHGQETTDSSDKKEKKSFSLEEKSKISKNRVHYMKFTKGKSWKALTLSQKRPYVDEAERLRLQHMQDYPNYKYRPRRKKQAKRLCKRVDPGFLLSSLSRDQNALPEKRSGSRGALGEKEDRGEYSPGTALPSLRGCYHEGPAGGGGGGTPSSVDTYPYGLPTPPEMSPLDVLEPEQTFFSSPCQEEHGHPRRIPHLPGHPYSPEYAPSPLHCSHPLGSLALGQSPGVSMMSPVPGCPPSPAYYSPATYHPLHSNLQAHLGQLSPPPEHPGFDALDQLSQVELLGDMDRNEFDQYLNTPGHPDSATGAMALSGHVPVSQVTPTGPTETSLISVLADATATYYNSYSVS

SEQ ID NO: 65446 - protein, 446 aa, Homo sapiens [sequence omitted]

SEQ ID NO: 65447 - protein, 509 aa, Homo sapiens
MNLLDPFMKMTDEQEKGLSGAPSPTMSEDSAGSPCPSGSGSDTENTRPQENTFPKGEPDLKKESEEDKFPVCIREAVSQVLKGYDWTLVPMPVRVNGSSKNKPHVKRPMNAFMVWAQAARRKLADQYPHLHNAELSKTLGKLWRLLNESEKRPFVEEAERLRVQHKKDHPDYKYQPRRRKSVKNGQAEAEEATEQTHISPNAIFKALQADSPHSSSGMSEVHSPGEHSGQSQGPPTPPTTPKTDVQPGKADLKREGRPLPEGGRQPPIDFRDVDIGELSSDVISNIETFDVNEFDQYLPPNGHPGVPATHGQVTYTGSYGISSTAATPASAGHVWMSKQQAPPPPPQQPPQAPPAPQAPPQPQAAPPQQPAAPPQQPQAHTLTTLSSEPGQSQRTHIKTEQLSPSHYSEQQQHSPQQIAYSPFNLPHYSPSYPPITRSQYDYTDHQNSSSYYSHAAGQGTGLYSTFTYMNPAQRPMYTPIADTSGVPSIPQTHSPQHWEQPVYTQLTRP

SEQ ID NO: 65448 - protein, 445 aa, Homo sapiens
MNLLDPFMKMTDEQEKGLSGAPSPTMSEDSAGSPCPSGSGSDTENTRPQENTFPKGEPDLKKESEEDKFPVCIREAVSQVLKGYDWTLVPMPVRVNGSSKNKPHVKRPMNAFMVWAQAARRKLADQYPHLHNAELSKTLGKLWRLLNESEKRPFVEEAERLRVQHKKDHPDYKYQPRRRKSVKNGQAEAEEATEQTHISPNAIFKALQADSPHSSSGMSEVHSPGEHSGQSQGPPTPPTTPKTDVQPGKADLKREGRPLPEGGRQPPIDFRDVDIGELSSDVISNIETFDVNEFDQYLPPNGHPGVPATHGQVTYTGSYGISSTAATPASAGHVWMSKQQAPPPPPQQHSPQQIAYSPFNLPHYSPSYPPITRSQYDYTDHQNSSSYYSHAAGQGTGLYSTFTYMNPAQRPMYTPIADTSGVPSIPQTHSPQHWEQPVYTQLTRP

SEQ ID NO: 65449 - protein, 90 aa, Homo sapiens
MRGYLVAIFLSAVFLYYVLHCILWGTNVYWVAPVEMKRRNKIQPCLSKPAFASLLSQSSAYILRKGIEELNQTSILFTQVSSVSPFSVCG

SEQ ID NO: 65450 - protein, 90 aa, Homo sapiens; identical to SEQ ID NO: 65449

SEQ ID NO: 65451 - protein, 444 aa, Homo sapiens
MGLLVFVRNLLLALCLFLVLGFLYYSAWKLHLLQWEEDSSKYSHSSSPQEKPVADSVVLSFDSAGQTLGSEYDRLGFLLNLDSKLSPRTLCTVVFGLDCILESPGEPKKLLMPASHPLEILKSLSEDTAFALGFLKLPRPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 65452 - protein, 155 aa, Homo sapiens
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQVLDAQYPARERVSAEAGESSRHH

SEQ ID NO: 65453 - protein, 344 aa, Homo sapiens
MGLLVFVRNLLLALCLFLVLGFLYYSAWKLHLLQWEEDSNSVVLSFDSAGQTLGSEYDRLGFLLNLDSKLFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 65454 - protein, 228 aa, Homo sapiens
MGLLVFVRNLLLALCLFLVLGFLYYSAWKLHLLQWEEDSKYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRVHRMASGNLWPLECPRSPLRFESSTHISSRRPPSPSLACPSTMASWAGGTSLPLAVWQ

SEQ ID NO: 65455 - protein, 390 aa, Homo sapiens
MGLLVFVRNLLLALCLFLVLGFLYYSAWKLHLLQWEEDSSKYSHSSSPQEKPVADSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 65456 - protein, 413 aa, Homo sapiens
MGLLVFVRNLLLALCLFLVLGFLYYSAWKLHLLQWEEDSKYDRLGFLLNLDSKLSPRTLCTVVFGLDCILESPGEPKKLLMPASHPLEILKSLSEDTAFALGFLKLPRPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 65457 - protein, 277 aa, Homo sapiens
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSWTHNIQREKEFLRKLVKARVITDLSSGI

SEQ ID NO: 65458 - protein, 375 aa, Homo sapiens
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 65459 - protein, 359 aa, Homo sapiens
MGLLVFVRNLLLALCLFLVLGFLYYSAWKLHLLQWEEDSKYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 65460 - protein, 444 aa, Homo sapiens; identical to SEQ ID NO: 65451

SEQ ID NO: 65461 - protein, 170 aa, Homo sapiens
MGLLVFVRNLLLALCLFLVLGFLYYSAWKLHLLQWEEDSSKYSHSSSPQEKPVADSVVLSFDSAGQTLGSEYDRLGFLLNLDSKLPAELATKYANFSEGACKPGYASALMTAIFPRFSKPAPMFLDDSFRKWARIREFVPPFGIKGQVLDAQYPARERVSAEAGESSRHH

SEQ ID NO: 65462 - protein, 155 aa, Homo sapiens; identical to SEQ ID NO: 65452

SEQ ID NO: 65463 - protein, 186 aa, Homo sapiens
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVR

SEQ ID NO: 65464 - protein, 185 aa, Homo sapiens
MGLLVFVRNLLLALCLFLVLGFLYYSAWKLHLLQWEEDSSKYSHSSSPQEKPVAEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVR

SEQ ID NO: 65465 - protein, 201 aa, Homo sapiens
MGLLVFVRNLLLALCLFLVLGFLYYSAWKLHLLQWEEDSSKYSHSSSPQEKPVAEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVSPGRTISSERKSFCGSW

SEQ ID NO: 65466 - protein, 429 aa, Homo sapiens
MGLLVFVRNLLLALCLFLVLGFLYYSAWKLHLLQWEEDSNSVVLSFDSAGQTLGSEYDRLGFLLNLDSKLSPRTLCTVVFGLDCILESPGEPKKLLMPASHPLEILKSLSEDTAFALGFLKLPRPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 65467 - protein, 345 aa, Homo sapiens
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 65468 - protein, 413 aa, Homo sapiens; identical to SEQ ID NO: 65456

SEQ ID NO: 65469 - protein, 344 aa, Homo sapiens; identical to SEQ ID NO: 65453

SEQ ID NO: 65470 - protein, 429 aa, Homo sapiens; identical to SEQ ID NO: 65466

SEQ ID NO: 65471 - protein, 151 aa, Homo sapiens
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQECIGWLLEICGHSSAQGAP

SEQ ID NO: 65472 - protein, 186 aa, Homo sapiens
MGLLVFVRNLLLALCLFLVLGFLYYSAWKLHLLQWEEDSKYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVSPGRTISSERKSFCGSW

SEQ ID NO: 65473 - protein, 139 aa, Homo sapiens
MGLLVFVRNLLLALCLFLVLGFLYYSAWKLHLLQWEEDSKYDRLGFLLNLDSKLPAELATKYANFSEGACKPGYASALMTAIFPRFSKPAPMFLDDSFRKWARIREFVPPFGIKGQVLDAQYPARERVSAEAGESSRHH

SEQ ID NO: 65474 - protein, 101 aa, Homo sapiens
MGLLVFVRNLLLALCLFLVLGFLYYSAWKLHLLQWEEDSKYDRLGFLLNLDSKLPAELATKYANFSEGACKPGYASALMTAIFPRPGRTISSERKSFCGSW

SEQ ID NO: 65475 - protein, 261 aa, Homo sapiens
MGLLVFVRNLLLALCLFLVLGFLYYSAWKLHLLQWEEDSKYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSWTHNIQREKEFLRKLVKARVITDLSSGI

SEQ ID NO: 65476 - protein, 277 aa, Homo sapiens; identical to SEQ ID NO: 65457

SEQ ID NO: 65477 - protein, 170 aa, Homo sapiens; identical to SEQ ID NO: 65461

SEQ ID NO: 65478 - protein, 213 aa, Homo sapiens
MRTSAEYFRLALSKLQSCDLFDEFDKMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAITLAFYICHEVHLAGFKYNFSDLKSPLHYYGNATMSLMNKNAYHNVTAEQLFLKDIIEKNLVINLTQD

SEQ ID NO: 65479 - protein, 331 aa, Homo sapiens
MRGYLVAIFLSAVFLYYVLHCILWGTNVYWVAPVEMKRRNKIQPCLSKPAFASLLRFHQFHPFLCAADFRKIASLYGSDKFDLPYGMRTSAEYFRLALSKLQSCDLFDEFDNIPCKKCVVVGNGGVLKNKTLGEKIDSYDVIIRMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAITLAFYICHEVHLAGFKYNFSDLKSPLHYYGNATMSLMNKNAYHNVTAEQLFLKDIIEKNLVINLTQD

SEQ ID NO: 65480 - protein, 331 aa, Homo sapiens; identical to SEQ ID NO: 65479

SEQ ID NO: 65481 - protein, 231 aa, Homo sapiens
MRGYLVAIFLSAVFLYYVLHCILWGTNVYWVAPVEMKRRNKIQPCLSKPAFASLLRFHQFHPFLCAADFRKIASLYGSDKFDLPYGMRTSAEYFRLALSKLQSCDLFDEFDNIPCKKCVVVGNGGVLKNKTLGEKIDSYDVIIRMNNGPVLGHEEEVGRRTTFRLFYPESVFSDPIHNDPNTTVILTAFKPHDLRWLLELLMGDKINTNGFWKKPALNLIYKPYQIRILDP

SEQ ID NO: 65482 - protein, 246 aa, Homo sapiens
MHCRDCALVTSSGHLLHSRQGSQIDQTECVIRMNDAPTRGYGRDVGNRTSLRVIAHSSIQRILRNRHDLLNVSQGTVFIFWGPSSYMRRDGKGQVYNNLHLLSQVLPRLKAFMITRHKMLQFDELFKQETGKDRKISNTWLSTGWFTMTIALELCDRINVYGMVPPDFCRDPNHPSVPYHYYEPFGPDECTMYLSHERGRKGSHHRFITEKRVFKNWARTFNIHFFQPDWKPESLAINHPENKPVF

SEQ ID NO: 65483 - protein, 336 aa, Homo sapiens
MKTLMRHGLAVCLALTTMCTSLLLVYSSLGGQKERPPQQQQQQQQQQQQASATGSSQPAAESSTQQRPGVPAGPRPLDGYLGVADHKPLKMHCRDCALVTSSGHLLHSRQGSQIDQTECVIRMNDAPTRGYGRDVGNRTSLRVIAHSSIQRILRNRHDLLNVSQGTVFIFWGPSSYMRRDGKGQVYNNLHLLSQVLPRLKAFMITRHKMLQFDELFKQETGKDRKISNTWLSTGWFTMTIALELCDRINVYGMVPPDFCRDPNHPSVPYHYYEPFGPDECTMYLSHERGRKGSHHRFITEKRVFKNWARTFNIHFFQPDWKPESLAINHPENKPVF

SEQ ID NO: 65484 - protein, 424 aa, Homo sapiens
MSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKEAEELARNMAIQQELEKEKQRVAQQKQQQLEQEQFHAFEEMIRNQELEKERLKIVQEFGKVDPGLGGPLVPDLEKPSLDVFPTLTVSSIQPSDCHTTVRPAKPPVVDRSLKPGALSNSESIPTIDGLRHVVVPGRLCPQFLQLASANTARGVETCGILCGKLMRNEFTITHVLIPKQSAGSDYCNTENEEELFLIQDQQGLITLGWIHTHPTQTAFLSSVDLHTHCSYQMMLPESVAIVCSPKFQETGFFKLTDHGLEEISSCRQKGFHPHSKDPPLFCSCSHVTVVDRAVTITDLR

SEQ ID NO: 65485 - protein, 424 aa, Homo sapiens; identical to SEQ ID NO: 65484

SEQ ID NO: 65486 - protein, 424 aa, Homo sapiens; identical to SEQ ID NO: 65484

SEQ ID NO: 65487 - protein, 424 aa, Homo sapiens; identical to SEQ ID NO: 65484

SEQ ID NO: 65488 - protein, 163 aa, Homo sapiens
MSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKEAEELARNMAIQQELEKEKQRVAQQKQQQLEQEQFH

SEQ ID NO: 65489 - protein, 318 aa, Homo sapiens
MSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKEAEELARNMAIQQELEKEKQRVAQQKQQQLEQEQFHAFEEMIRNQELEKERLKIVQEFGKVDPGLGGPLVPDLEKPSLDVFPTLTVSSIQPSDCHTTVRPAKPPVVDRSLKPGALSNSESIPTIDGLRHVVVPGRLCPQFLQLASANTARGVETCGILCGKLMRNEFTITHVLIPKQSAGSDYCNTENEEE

SEQ ID NO: 65490 - protein, 137 aa, Homo sapiens
MSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKEAEELARNMA

SEQ ID NO: 65491 - protein, 348 aa, Homo sapiens
MSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKEAEELARNMAIQQELEKEKQRVAQQKQQQLEQEQFHAFEEMIRNQELEKERLKIVQEFGKVDPGLGGPLVPDLEKPSLDVFPTLTVSSIQPSDCHTTVRPAKPPVVDRSLKPGALSNSESIPTIDGLRHVVVPGRLCPQFLQLASANTARGVETCGILCGKLMRNEFTITHVLIPKQSAGSDYCNTENEEELFLIQDQQGLITLGWIHVETLWSLKSLHAP

SEQ ID NO: 65492 - protein, 270 aa, Homo sapiens
MRQQQLESEQFLFFEDQLKKQELARGQMRSQQTSGLSEQIDGSALSCFSTHQNNSLLNVFADQPNKSDATNYASHSPPVNRALTPAATLSAVQNLVVEGLRCVVLPEDLCHKFLQLAESNTVRGIETCGILCGKLTHNEFTITHVIVPKQSAGPDYCDMENVEELFNVQDQHDLLTLGWIHTHPTQTAFLSSVDLHTHCSYQLMLPEAIAIVCSPKHKDTGIFRLTNAGMLEVSACKKKGFHPHTKEPRLFSICKHVLVKDIKIIVLDLR

SEQ ID NO: 65493 - protein, 436 aa, Homo sapiens
MDQPFTVNSLKKLAAMPDHTDVSLSPEERVRALSKLGCNITISEDITPRRYFRSGVEMERMASVYLEEGNLENAFVLYNKFITLFVEKLPNHRDYQQCAVPEKQDIMKKLKEIAFPRTDELKNDLLKKYNVEYQEYLQSKNKYKAEILKKLEHQRLIEAERKRIAQMRQQQLESEQFLFFEDQLKKQELARGQMRSQQTSGLSEQIDGSALSCFSTHQNNSLLNVFADQPNKSDATNYASHSPPVNRALTPAATLSAVQNLVVEGLRCVVLPEDLCHKFLQLAESNTVRGIETCGILCGKLTHNEFTITHVIVPKQSAGPDYCDMENVEELFNVQDQHDLLTLGWIHTHPTQTAFLSSVDLHTHCSYQLMLPEAIAIVCSPKHKDTGIFRLTNAGMLEVSACKKKGFHPHTKEPRLFSICKHVLVKDIKIIVLDLR

SEQ ID NO: 65494 - protein, 436 aa, Homo sapiens; identical to SEQ ID NO: 65493

SEQ ID NO: 65495 - protein, 461 aa, Homo sapiens
MDQPFTVNSLKKLAAMPDHTDVSLSPEERVRALSKLGCNITISEDITPRRYFRSGVEMERMASVYLEEGNLENAFVLYNKFITLFVEKLPNHRDYQQCAVPEKQDIMKKLKEIAFPRTDELKNDLLKKYNVEYQEYLQSKNKYKAEILKKLEHQRLIEAERKRIAQMRQQQLESEQFLFFEDQLKKQELARGQMRSQQTSGLSEQIDGSALSCFSTHQNNSLLNVFADQPNKSDATNYASHSPPVNRALTPAATLSAVQNLVVEGLRCVVLPEDLCHKFLQLAESNTVRGIETCGILCGKLTHNEFTITHVIVPKQSAGPDYCDMENVEELFNVQDQHDLLTLGWIHTHPTQTAFLSSVDLHTHCSYQLMLPEAIAIVCSPKHKDTGIFRLTNAGMLEVSACKKKGFHPHTKEPRLFSIQKFLSGIISGTALEMEPLKIGYGPNGFPLLGISRSSSPSEQL

SEQ ID NO: 65496 - protein, 88 aa, Homo sapiens
MSIMDHSPTTGVVTVIVILIAIAALGALILGCWCYLRLQRISQSEDEESIVGDGETKEPFLLVQYSAKGPCVERKAKLMTPNGPEVHG

SEQ ID NO: 65497 - protein, 247 aa, Homo sapiens
MLQNSAVLLVLVISASATHEAEQNDSVSPRKSRVAAQNSAEVVRCLNSALQVGCGAFACLENSTCDTDGMYDICKSFLYSAAKFDTQGKAFVKESLKCIANGVTSKVFLAIRRCSTFQRMIAEVQEECYSKLNVCSIAKRNPEAITEVVQLPNHFSNRYYNRLVRSLLECDEDTVSTIRDSLMEKIGPNMASLFHILQTDHCAQTHPRADFNRRRTNEPQKLKVLLRNLRGEEDSPSHIKRTSHESA

SEQ ID NO: 65498 - protein, 178 aa, Homo sapiens
MYDICKSFLYSAAKFDTQGKAFVKESLKCIANGVTSKVFLAIRRCSTFQRMIAEVQEECYSKLNVCSIAKRNPEAITEVVQLPNHFSNRYYNRLVRSLLECDEDTVSTIRDSLMEKIGPNMASLFHILQTDHCAQTHPRADFNRRRTNEPQKLKVLLRNLRGEEDSPSHIKRTSHESA

SEQ ID NO: 65499 - protein, 178 aa, Homo sapiens; identical to SEQ ID NO: 65498

SEQ ID NO: 65500 - protein, 910 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 65501 - protein, 900 aa, Homo sapiens
MASSAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 65502 - protein, 234 aa, Homo sapiens
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALTTAVTSAFLLAKVILSKLFSQGAFGYVLPIISFILAWIETWFLDFKVLPQEAEEENRLLIVQDASERAALIPGGLSDGQFYSPPESEAGSEEAEEKQDSEKPLLEL

SEQ ID NO: 65503 - protein, 234 aa, Homo sapiens; identical to SEQ ID NO: 65502

SEQ ID NO: 65504 - protein, 206 aa, Homo sapiens
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALTTAVTSAFLLAKVILSKLFSQGAFGYVLPIISFILAWIETWFLDFKVLPQEAEEENRLLIVQDASERAALIPGGLSDG

SEQ ID NO: 65505 - protein, 184 aa, Homo sapiens
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALTTAVTSAFLLAKVILSKLFSQGAFGYVLPIISFILAWIETWFLDFKVLPQEAEEEN

SEQ ID NO: 65506 - protein, 172 aa, Homo sapiens
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALTTAVTSAFLLAKVILSKLFSQGAFGYVLPIISFILAWIETWFLD

SEQ ID NO: 65507 - protein, 227 aa, Homo sapiens
MENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALTTAVTSAFLLAKVILSKLFSQGAFGYVLPIISFILAWIETWFLDFKVLPQEAEEENRLLIVQDASERAALIPGGLSDGQFYSPPESEAGSEEAEEKQDSEKPLLEL

SEQ ID NO: 65508 - protein, 445 aa, Homo sapiens
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLRLRHWWVIAVTTLVSSAFLIVKVILSELLSKGAFGYLLPIVSFVLAWLETWFLDFKVLPQEAEEERWYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKGRLPRYLIHQSLAATMFEFAFHLRQRISELGARA

SEQ ID NO: 65509 - protein, 427 aa, Homo sapiens
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLRLRHWWVIALLSKGAFGYLLPIVSFVLAWLETWFLDFKVLPQEAEEERWYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKGRLPRYLIHQSLAATMFEFAFHLRQRISELGARA

SEQ ID NO: 65510 - protein, 196 aa, Homo sapiens
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLRLRHWWVIAVTTLVSSAFLIVKVILSELLSKGAFGYLLPIVSFVLAWLETWFLDFKVLPQEAEEERWYLAAQVAVARGPL

SEQ ID NO: 65511 - protein, 445 aa, Homo sapiens
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLRLRHWSRRWCPVHSSLSRSSSLSCSAKGHLATCSPSSLLSSPGWRPGSLTSKSYPRKLKRSDSAPPGYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKGRLPRYLIHQSLAATMFEFAFHLRQRISELGARA

SEQ ID NO: 65512 - protein, 205 aa, Homo sapiens
MEGLSDVASFATKLKNTLIQYHSIEEDKWRVAKKTKDVTVWRKPSEEFNGYLYKAQGVIDDLVYSIIDHIRPGPCRLDWDSLMTSLDILENFEENCCVMRYTTAGQLWNIISPREFVDFSYTVGYKEGLLSCGISLDWDEKRPEFVRGYNHPCGWFCVPLKDNPNQSLLTGYIQTDLRGMIPQSAVDTAMASTLTNFYGDLRKAL

SEQ ID NO: 65513 - protein, 191 aa, Homo sapiens
MEGLSDVASFATKLKNTLIQYHSIEEDKWRVAKKTKDVTVWRKPSEEFNGYLYKAQGVIDDLVYSIIDHIRPGPCRLDWDSLMTSLDILENFEENCCVMRYTTAGQLWNIISPREFVDFSYTVGYKEGLLSCGISLDWDEKRPEFVRGYNHPCGWFCVPLKDNPNQSLLTGYIQTDLRGMIPQSAVDTAMA

SEQ ID NO: 65514 - protein, 213 aa, Homo sapiens
MDPALAAQMSEAVAEKMLQYRRDTAGWKICREGNGVSVSWRPSVEFPGNLYRGEGIVYGTLEEVWDCVKPAVGGLRVKWDENVTGFEIIQSITDTLCVSRTSTPSAAMKLISPRDFVDLVLVKRYEDGTISSNATHVEHPLCPPKPGFVRGFNHPCGCFCEPLPGEPTKTNLVTFFHTDLSGYLPQNVVDSFFPRSMTRFYANLQKAVKQFHE

SEQ ID NO: 65515 - protein, 220 aa, Homo sapiens
MDFKAIAQQTAQEVLGYNRDTSGWKVVKTSKKITVSSKASRKFHGNLYRVEGIIPESPAKLSDFLYQTGDRITWDKSLQVYNMVHRIDSDTFICHTITQSFAVGSISPRDFIDLVYIKRYEGNMNIISSKSVDFPEYPPSSNYIRGYNHPCGFVCSPMEENPAYSKLVMFVQTEMRGKLSPSIIEKTMPSNLVNFILNAKDGIKAHRTPSRRGFHHNSHS

SEQ ID NO: 65516 - protein, 1023 aa, Homo sapiens
MTLNNCASMKLEVHFQSKQNEDSEEEEQCTISSHWAFQQESKCWSPMGSSDLLAPPSPGLPATSSCESVLTELSATSLPVITVSLPPEPADLPLPGRAPSSSDRPLLSPTQGQEGPQDKAKKRHRNRSFLKHLESLRRKEKSGSQQAEPKHSPATSEKVSKASSFRSCRGFLSAGFYRAKNWAATSAGGSGANTRKAWEAWPVASFRHPQWTHRGDCLVHVPGDHKPGTFPRSLSIESLCPEDGHRLADWQPGRRWGCEGRRGSCGSTGSHASTYDNLPELYPAEPVMVGAEAEDEDDEESGGSYAHLDDILQHVWGLQQRVELWSRAMYPDLGPGDEEEEEATSSVEIATVEVKCQAEALSQMEVPAHGESPAWAQAEVQPAVLAPAQAPAEAEPVAQEEAEAPAPAPAPAPAQDSEQEAHSGGEPTFASSLSVEEGHSISDTVASSSELDSSGNSMNEAEAAGPLAGLQASMPRERRDSGVGASLTRPCRKLRWHSFQNSHRPSLNSESLEINRQFAGQINLLHKGSLLRLTAFMEKYTVPHKQGWVWSMPKFMRRNKTPDYRGQHVFGVPPLIHVQRTGQPLPQSIQQAMRYLRSQCLDQVGIFRKSGVKSRIQNLRQMNETSPDNVCYEGQSAYDVADLLKQYFRDLPEPIFTSKLTTTFLQIYQLLPKDQWLAAAQAATLLLPDENREVLQTLLYFLSDIASAEENQMTAGNLAVCLAPSIFHLNVSKKDSPSPRIKSKRSLIGRPGPRDLSDNMAATQGLSHMISDCKKLFQVPQDMVLQLCSSYSAAELSPPGPALAELRQAQAAGVSLSLYMEENIQDLLRDAAERFKGWMSVPGPQHTELACRKAPDGHPLRLWKASTEVAAPPAVVLHRVLRERALWDEDLLRAQVLEALMPGVELYHYVTDSMAPHPCRDFVVLRMWRSDLPRGGCLLVSQSLDPEQPVPESGVRALMLTSQYLMEPCGLGRSRLTHICRADLRGRSPDWYNKVFGHLCAMEVAKIRDSFPTLQAAGPETKL

SEQ ID NO: 65517 - protein, 1023 aa, Homo sapiens; identical to SEQ ID NO: 65516

SEQ ID NO: 65518 - protein, 1103 aa, Homo sapiens
MPLLDVFWSCFRKVKCFPLLQVKKNAEAEAKRACEWLQATGFPQYVQLFEEGSFPLDIGSVKKNHGFLDEDSLGALCRRLMTLNNCASMKLEVHFQSKQNEDSEEEEQCTISSHWAFQQESKCWSPMGSSDLLAPPSPGLPATSSCESVLTELSATSLPVITVSLPPEPADLPLPGRAPSSSDRPLLSPTQGQEGPQDKAKKRHRNRSFLKHLESLRRKEKSGSQQAEPKHSPATSEKVSKASSFRSCRGFLSAGFYRAKNWAATSAGGSGANTRKAWEAWPVASFRHPQWTHRGDCLVHVPGDHKPGTFPRSLSIESLCPEDGHRLADWQPGRRWGCEGRRGSCGSTGSHASTYDNLPELYPAEPVMVGAEAEDEDDEESGGSYAHLDDILQHVWGLQQRVELWSRAMYPDLGPGDEEEEEATSSVEIATVEVKCQAEALSQMEVPAHGESPAWAQAEVQPAVLAPAQAPAEAEPVAQEEAEAPAPAPAPAPAQDSEQEAHSGGEPTFASSLSVEEGHSISDTVASSSELDSSGNSMNEAEAAGPLAGLQASMPRERRDSGVGASLTRPCRKLRWHSFQNSHRPSLNSESLEINRQFAGQINLLHKGSLLRLTAFMEKYTVPHKQGWVWSMPKFMRRNKTPDYRGQHVFGVPPLIHVQRTGQPLPQSIQQAMRYLRSQCLDQVGIFRKSGVKSRIQNLRQMNETSPDNVCYEGQSAYDVADLLKQYFRDLPEPIFTSKLTTTFLQIYQLLPKDQWLAAAQAATLLLPDENREVLQTLLYFLSDIASAEENQMTAGNLAVCLAPSIFHLNVSKKDSPSPRIKSKRSLIGRPGPRDLSDNMAATQGLSHMISDCKKLFQVPQDMVLQLCSSYSAAELSPPGPALAELRQAQAAGVSLSLYMEENIQDLLRDAAERFKGWMSVPGPQHTELACRKAPDGHPLRLWKASTEVAAPPAVVLHRVLRERALWDEDLLRAQVLEALMPGVELYHYVTDSMAPHPCRDFVVLRMWRSDLPRGGCLLVSQSLDPEQPVPESGVRALMLTSQYLMEPCGLGRSRLTHICRADLRGRSPDWYNKVFGHLCAMEVAKIRDSFPTLQAAGPETKL

SEQ ID NO: 65519 - protein, 52 aa, Homo sapiens
MPLLDVFWSCFRKVKCFPLLQVKKNAEAEAKRACEWLQATGFPQYVQLFEGG

SEQ ID NO: 65520 - protein, 62 aa, Homo sapiens
MKFLVFAFILALMVSMIGADSSEEKFLRRIGRFGYGYGPYQPVPEQPLYPQPYQPQYQQYTF

SEQ ID NO: 65521 - protein, 52 aa, Homo sapiens
MKFLVFAFILALMVSMIGADSSEEYGYGPYQPVPEQPLYPQPYQPQYQQYTF

SEQ ID NO: 65522 - protein, 179 aa, Homo sapiens
MAKTAMAYKEKMKELSMLSLICSCFYPEPRNINIYTYDDMEVKQINKRASGQAFELILKPPSPISEAPRTLASPKKKDLSLEEIQKKLEAAEERRKSQEAQVLKQLAEKREHEREVLQKALEENNNFSKMAEEKLILKMEQIKENREANLAAIIERLQEKERHAAEVRRNKELQVELSG

SEQ ID NO: 65523 - protein, 168 aa, Homo sapiens
MAKTAMAYKEKMKELSMLSLICSCFYPEPRNINIYTYDDMEVKQINKRASGQAFELILKPPSPKKKDLSLEEIQKKLEAAEERRKSQEAQVLKQLAEKREHEREVLQKALEENNNFSKMAEEKLILKMEQIKENREANLAAIIERLQEKERHAAEVRRNKELQVELSG

SEQ ID NO: 65524 - protein, 187 aa, Homo sapiens
MAKTAMAYKEKMKELSMLSLICSCFYPEPRNINIYTYDDMEVKQINKRASGQAFELILKPPSPISEAPRTLASPKKKDLSLEEIQKKLEAAEERRKSQEAQVLKQLAEKREHEREVLQKALEENNNFSKMAEEKLILKMEQIKENREANLAAIIERLQEKLVKFISSELKESIESQFLELQREGEKQ

SEQ ID NO: 65525 - protein, 180 aa, Homo sapiens
MASTISAYKEKMKELSVLSLICSCFYTQPHPNTVYQYGDMEVKQLDKRASGQSFEVILKSPSDLSPESPMLSSPPKKKDTSLEELQKRLEAAEERRKTQEAQVLKQLAERREHEREVLHKALEENNNFSRQAEEKLNYKMELSKEIREAHLAALRERLREKELHAAEVRRNKEQREEMSG

SEQ ID NO: 65526 - protein, 169 aa, Homo sapiens
MKELSVLSLICSCFYTQPHPNTVYQYGDMEVKQLDKRASGQSFEVILKSPSDLSPESPMLSSPPKKKDTSLEELQKRLEAAEERRKTQEAQVLKQLAERREHEREVLHKALEENNNFSRQAEEKLNYKMELSKEIREAHLAALRERLREKELHAAEVRRNKEQREEMSG

SEQ ID NO: 65527 - protein, 473 aa, Homo sapiens
MFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQV

SEQ ID NO: 65528 - protein, 504 aa, Homo sapiens
MKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQVHYCDRQSGKECVTCLTLAPVQMTFHAIGSSIEASHDQAALSALKQFSEQGLDPIDGAMNIEKGSLEKQAKHLREKADNNQAPPGSIAQDCKKSNSAV

SEQ ID NO: 65529 - protein, 398 aa, Homo sapiens
MKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQAALSALKQFSEQGLDPIDGAMNIEKGSLEKQAKHLREKADNNQAPPGSIAQDCKKSNSAV

SEQ ID NO: 65530 - protein, 479 aa, Homo sapiens
MLQINQMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQV

SEQ ID NO: 65531 - protein, 204 aa, Homo sapiens
MLQINQMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHM

SEQ ID NO: 65532 - protein, 64 aa, Homo sapiens
MLQINQMFSVQLSLGEQTWESEGSSIKKAQQAVANKALTESTLPKPVQKPPKSNVNNNPGSITP

SEQ ID NO: 65533 - protein, 479 aa, Homo sapiens; identical to SEQ ID NO: 65530

SEQ ID NO: 65534 - protein, 538 aa, Homo sapiens
MLQINQMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQAALSALKQFSEQGLDPIDGAMNIEKGSLEKQAKHLREKADNNQAPPGSIAQDCKKSNSAV

SEQ ID NO: 65535 - protein, 105 aa, Homo sapiens
MLQINQMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQR

SEQ ID NO: 65536 - protein, 570 aa, Homo sapiens
MANPKEKTAMCLVNELARFNRVQPQYKLLNERGPAHSKMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQAALSALKQFSEQGLDPIDGAMNIEKGSLEKQAKHLREKADNNQAPPGSIAQDCKKSNSAV

SEQ ID NO: 65537 - protein, 347 aa, Homo sapiens
SLLTNDASSESIASFSKQEVMSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGDSPSHPYHRTFSPHFHHFVEQCLQRNPDARYPCWPGPGLRESRGCSGG

SEQ ID NO: 65538 - protein, 431 aa, Homo sapiens
MSFLVSKPERIRRWVSEKFIVEGLRDLELFGEQPPGDTRRKTNDASSESIASFSKQEVMSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGDSPSHPYHRTFSPHFHHFVEQCLQRNPDARPSASTLLNHSFFKQIKRRASEALPELLRPVTPITNFEGSQSQDHSGIFGLVTNLEELEVDDWEF

SEQ ID NO: 65539 - protein, 373 aa, Homo sapiens
MSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGDSPSHPYHRTFSPHFHHFVEQCLQRNPDARPSASTLLNHSFFKQIKRRASEALPELLRPVTPITNFEGSQSQDHSGIFGLVTNLEELEVDDWEF

SEQ ID NO: 65540 - protein, 348 aa, Homo sapiens
MSFLTNDASSESIASFSKQEVMSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGDSPSHPYHRTFSPHFHHFVEQCLQRNPDARYPCWPGPGLRESRGCSGG

SEQ ID NO: 65541 - protein, 299 aa, Homo sapiens
MSFLVSKPERIRRWVSEKFIVEGLRDLELFGGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGPVPAPS

SEQ ID NO: 65542 - protein, 418 aa, Homo sapiens
MSLLDCFCTSRTQVESLRPEKQSETSIHQYLVDEPTLSWSRPSTRASEVLCSTNVSHYELQVEIGRGFDNLTSVHLARHTPTGTLVTIKITNLENCNEERLKALQKAVILSHFFRHPNITTYWTVFTVGSWLWVISPFMAYGSASQLLRTYFPEGMSETLIRNILFGAVRGLNYLHQNGCIHRSIKASHILISGDGLVTLSGLSHLHSLVKHGQRHRAVYDFPQFSTSVQPWLSPELLRQDLHGYNVKSDIYSVGITACELASGQVPFQDMHRTQMLLQKLKGPPYSPLDISIFPQSESRMKNSQSGVDSGIGESVLVSSGTHTVNSDRLHTPSSKTFSPAFFSLVQLCLQQDPEKRPSASSLLSHVFFKQMKEESQDSILSLLPPAYNKPSISLPPVLPWTEPECDFPDEKDSYWEF

SEQ ID NO: 65543 - protein, 377 aa, Homo sapiens
MSLLDCFCTSRTQVESLRPEKQSETSIHQYLVDEPTLSWSRPSTRASEVLCSTNVSHYELQVEIGRGFDNLTSVHLARHTPTGTLVTIKITNLENCNEERLKALQKAVILSHFFRHPNITTYWTVFTVGSWLWVISPFMAYGSASQLLRTYFPEGMSETLIRNILFGAVRGLNYLHQNGCIHRSIKASHILISGDGLVTLSGLSHLHSLVKHGQRHRAVYDFPQFSTSVQPWLSPELLRQDLHGYNVKSDIYSVGITACELASGQVPFQDMHRTQMLLQKLKGPPYSPLDISIFPQSESRMKNSQSGVDSGIGESVLVSSGTHTVNSDRLHTPSSKTFSPAFFSLVQLCLQQDPEKRPSASSLLSHVFFKQPYFEFL

SEQ ID NO: 65544 - protein, 280 aa, Homo sapiens
LGYCSASQLLRTYFPEGMSETLIRNILFGAVRGLNYLHQNGCIHRSIKASHILISGDGLVTLSGLSHLHSLVKHGQRHRAVYDFPQFSTSVQPWLSPELLRQDLHGYNVKSDIYSVGITACELASGQVPFQDMHRTQMLLQKLKGPPYSPLDISIFPQSESRMKNSQSGVDSGIGESVLVSSGTHTVNSDRLHTPSSKTFSPAFFSLVQLCLQQDPEKRPSASSLLSHVFFKQMKEESQDSILSLLPPAYNKPSISLPPVLPWTEPECDFPDEKDSYWEF

SEQ ID NO: 65545 - protein, 418 aa, Homo sapiens; identical to SEQ ID NO: 65542

SEQ ID NO: 65546 - protein, 419 aa, Homo sapiens
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQIFCSFADTQTELELEFVFLLTLLL

SEQ ID NO: 65547 - protein, 490 aa, Homo sapiens
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILGKIILFLPCISRKLKRIKKGWEKSQFLEEGMGGTIPHVSPERVTVM

SEQ ID NO: 65548 - protein, 490 aa, Homo sapiens; identical to SEQ ID NO: 65547

SEQ ID NO: 65549 - protein, 490 aa, Homo sapiens; identical to SEQ ID NO: 65547

SEQ ID NO: 65550 - protein, 454 aa, Homo sapiens
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILDLLQLCRYPD

SEQ ID NO: 65551 - protein, 454 aa, Homo sapiens; identical to SEQ ID NO: 65550

SEQ ID NO: 65552 - protein, 454 aa, Homo sapiens; identical to SEQ ID NO: 65550

SEQ ID NO: 65553 - protein, 88 aa, Homo sapiens
MESISMMGSPKSLSETFLPNGINGIKDARKVTVGVIGSGDFAKSLTIRLIRCGYHVVIGSRNPKFASEFFPHVVDVTHHEDALTKTNI

SEQ ID NO: 65554 - protein, 182 aa, Homo sapiens
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELA

SEQ ID NO: 65555 - protein, 488 aa, Homo sapiens
MPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQSSLGFVALVLSTLHTLTYGWTRAFEESRYKFYLPPTFTLTLLVPCVVILAKALFLLPCISRRLARIRRGWERESTIKFTLPTDHALAEKTSHV

SEQ ID NO: 65556 - protein, 488 aa, Homo sapiens; identical to SEQ ID NO: 65555

SEQ ID NO: 65557 - protein, 488 aa, Homo sapiens; identical to SEQ ID NO: 65555

SEQ ID NO: 65558 - protein, 488 aa, Homo sapiens; identical to SEQ ID NO: 65555

SEQ ID NO: 65559 - protein, 498 aa, Homo sapiens
MSHQPAVATKMPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQSSLGFVALVLSTLHTLTYGWTRAFEESRYKFYLPPTFTLTLLVPCVVILAKALFLLPCISRRLARIRRGWERESTIKFTLPTDHALAEKTSHV

SEQ ID NO: 65560 - protein, 457 aa, Homo sapiens
MPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQCVATSSAGNTGSGTRRPESQSQDPHLPAPHHQTSFLGPRSFCCSLVPVSTPYGHQEDLSWTR

SEQ ID NO: 65561 - protein, 488 aa, Homo sapiens; identical to SEQ ID NO: 65555

SEQ ID NO: 65562 - protein, 457 aa, Homo sapiens; identical to SEQ ID NO: 65560

SEQ ID NO: 65563 - protein, 143 aa, Homo sapiens
MEIYLSLGVLALGTLSLLAVTSLPSIANSLNWREFSFVQSSLGFVALVLSTLHTLTYGWTRAFEESRYKFYLPPTFTLTLLVPCVVILAKALFLLPCISRRLARIRRGWERESTIKFTLPTDHALSPLGFLFLVVQSGITVCK

SEQ ID NO: 65564 - protein, 283 aa, Homo sapiens
MEKTCIDALPLTMNSSEKQETVCIFGTGDFGRSLGLKMLQCGYSVVFGSRNPQKTTLLPSGAEVLSYSEAAKKSGIIIIAIHREHYDFLTELTEVLNGKILVDISNNLKINQYPESNAEYLAHLVPGAHVVKAFNTISAWALQSGALDASRQAILKKENPFSTSSAWLSDSYVALGILGFFLFVLLGITSLPSVSNAVNWREFRFVQSKLGYLTLILCTAHTLVYGGKRFLSPSNLRWYLPAAYVLGLIIPCTVLVIKFVLIMPCVDNTLTRIRQGWERNSKH

SEQ ID NO: 65565 - protein, 459 aa, Homo sapiens
MEKTCIDALPLTMNSSEKQETVCIFGTGDFGRSLGLKMLQCGYSVVFGSRNPQKTTLLPSGAEVLSYSEAAKKSGIIIIAIHREHYDFLTELTEVLNGKILVDISNNLKINQYPESNAEYLAHLVPGAHVVKAFNTISAWALQSGALDASRQVFVCGNDSKAKQRVMDIVRNLGLTPMDQGSLMAAKEIEKYPLQLFPMWRFPFYLSAVLCVFLFFYCVIRDVIYPYVYEKKDNTFRMAISIPNRIFPITALTLLALVYLPGVIAAILQLYRGTKYRRFPDWLDHWMLCRKQLGLVALGFAFLHVLYTLVIPIRYYVRWRLGNLTVTQAILKKENPFSTSSAWLSDSYVALGILGFFLFVLLGITSLPSVSNAVNWREFRFVQSKLGYLTLILCTAHTLVYGGKRFLSPSNLRWYLPAAYVLGLIIPCTVLVIKFVLIMPCVDNTLTRIRQGWERNSKH

SEQ ID NO: 65566 - protein, 359 aa, Homo sapiens
MPAHLLQDDISSSYTTTTTITAPPSRVLQNGGDKLETMPLYLEDDIRPDIKDDIYDPTYKDKEGPSPKVEYVWRNIILMSLLHLGALYGITLIPTCKFYTWLWGVFYYFVSALGITAGAHRLWSHRSYKARLPLRLFLIIANTMAFQNDVYEWARDHRAHHKFSETHADPHNSRRGFFFSHVGWLLVRKHPAVKEKGSTLDLSDLEAEKLVMFQRRYYKPGLLMMCFILPTLVPWYFWGETFQNSVFVATFLRYAVVLNATWLVNSAAHLFGYRPYDKNISPRENILVSLGAVGEGFHNYHHSFPYDYSASEYRWHINFTTFFIDCMAALGLAYDRKKVSKAAILARIKRTGDGNYKSG

SEQ ID NO: 65567 - protein, 242 aa, Homo sapiens
MPAHLLQDDISSSYTTTTTITAPPSRVLQNGGDKLETMPLYLEDDIRPDIKDDIYDPTYKDKEGPSPKVEYVWRNIILMSLLHLGALYGITLIPTCKFYTWLWGVFYYFVSALGITAGAHRLWSHRSYKARLPLRLFLIIANTMAFQNDVYEWARDHRAHHKFSETHADPHNSRRGFFFSHVGWLLVRKHPAVKEKGSTLDLSDLEAEKLVMFQRRYYKPGLLMMCFILPTLVPWYFWGETF

SEQ ID NO: 65568 - protein, 270 aa, Homo sapiens
MACRPRSPPRHQSRCDGDASPPSPARWSLGRKRRADGRRWRPEDAEEAEHRGAERRPESFTTPEGPKPRSRCSDWASAVEEDEMRTRVNKEMARYKRKLLINDFGRERKSSSGSSDSKESMSTVPADFETDESVLMRRQKQINYGKNTIAYDRYIKEVPRHLRQPGIHPKTPNKFKKYSRRSWDQQIKLWKVALHFWDPPAEEGCDLQEIHPVDLESAESSSEPQTSSQDDFDVYSGTPTKVRHMDSQVEDEFDLEACLTEPLRDFSAMS

SEQ ID NO: 65569 - protein, 1775 aa, Homo sapiens
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEALCENHLGPAPPYSISNFSIHLLCQHTKPATPQPHPSTTAICQTAVWYAVSWAPGAQGWLQACHDQFPDEFLDAICSNLSFSALSGSNRRLVKRLCAGLLPPPTSCPEGLPPVPLTPDIFWGCFLENETLWAERLCGEASLQAVPPSNQAWVQHVCQGPTPDVTASPPCHIGPCGERCPDGGSFLVMVCANDTMYEVLVPFWPWLAGQCRISRGGNDTCFLEGLLGPLLPSLPPLGPSPLCLTPGPFLLGMLSQLPRCQSSVPALAHPTRLHYLLRLLTFLLGPGAGGAEAQGMLGRALLLSSLPDNCSFWDAFRPEGRRSVLRTIGEYLEQDEEQPTPSGFEPTVNPSSGISKMELLACFSPVLWDLLQREKSVWALQILVQAYLHMPPENLQQLVLSAEREAAQGFLTLMLQGKLQGKLQVPPSEEQALGRLTALLLQRYPRLTSQLFIDLSPLIPFLAVSDLMRFPPSLLANDSVLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRLGPLACFLSPEELQSLVPLSDPTGPVERGLLECAANGTLSPEGRVAYELLGVLRSSGGAVLSPRELRVWAPLFSQLGLRFLQELSEPQLRAMLPVLQGTSVTPAQAVLLLGRLLPRHDLSLEELCSLHLLLPGLSPQTLQAIPRRVLVGACSCLAPELSRLSACQTAALLQTFRVKDGVKNMGTTGAGPAVCIPGQPIPTTWPDCLLPLLPLKLLQLDSLALLANRRRYWELPWSEQQAQFLWKKMQVPTNLTLRNLQALGTLAGGMSCEFLQQINSMVDFLEVVHMIYQLPTRVRGSLRACIWAELQRRMAMPEPEWTTVGPELNGLDSKLLLDLPIQLMDRLSNESIMLVVELVQRAPEQLLALTPLHQAALAERALQNLAPKETPVSGEVLETLGPLVGFLGTESTRQIPLQILLSHLSQLQGFCLGETFATELGWLLLQESVLGKPELWSQDEVEQAGRLVFTLSTEAISLIPREALGPETLERLLEKQQSWEQSRVGQLCREPQLAAKKAALVAGVVRPAAEDLPEPVPNCADVRGTFPAAWSATQIAEMELSDFEDCLTLFAGDPGLGPEELRAAMGKAKQLWGPPRGFRPEQILQLGRLLIGLGDRELQELILVDWGVLSTLGQIDGWSTTQLRIVVSSFLRQSGRHVSHLDFVHLTALGYTLCGLRPEELQHISSWEFSQAALFLGTLHLQCSEEQLEVLAHLLVLPGGFGPISNWGPEIFTEIGTIAAGIPDLALSALLRGQIQGVTPLAISVIPPPKFAVVFSPIQLSSLTSAQAVAVTPEQMAFLSPEQRRAVAWAQHEGKESPEQQGRSTAWGLQDWSRPSWSLVLTISFLGHLL

SEQ ID NO: 65570 - protein, 351 aa, Homo sapiens
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTQPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEAL

SEQ ID NO: 65571 - protein, 1775 aa, Homo sapiens; identical to SEQ ID NO: 65569

SEQ ID NO: 65572 - protein, 351 aa, Homo sapiens
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEAL

SEQ ID NO: 65573 - protein, 699 aa, Homo sapiens
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTQPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEALCENHLGPAPPYSISNFSIHLLCQHTKPATPQPHPSTTAICQTAVWYAVSWAPGAQGWLQACHDQFPDEFLDAICSNLSFSALSGSNRRLVKRLCAGLLPPPTSCPEGLPPVPLTPDIFWGCFLENETLWAERLCGEASLQAVPPSNQAWVQHVCQGPTPDVTASPPCHIGPCGERCPDGGSFLVMVCANDTMYEVLVPFWPWLAGQCRISRGGNDTCFLEGLLGPLLPSLPPLGPSPLCLTPGPFLLGMLSQLPRCQSSVPALAHPTRLHYLLRLLTFLLGPGAGGAEAQGMLGRALLLSSLPDNCSFWDAFRPEGRRSVLRTIGEYNKMRSSQPHQALNPLSTPALV

SEQ ID NO: 65574 - protein, 1002 aa, Homo sapiens
MELLACFSPVLWDLLQREKSVWALQILVQAYLHMPPENLQQLVLSAEREAAQGFLTLMLQGKLQGKLQVPPSEEQALGRLTALLLQRYPRLTSQLFIDLSPLIPFLAVSDLMRFPPSLLANDSVQQGYRGSEENSLEEDKGLRPMTPRSLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRLGPLACFLSPEELQSLVPLSDPTGPVERGLLECAANGTLSPEGRVAYELLGVLRSSGGAVLSPRELRVWAPLFSQLGLRFLQELSEPQLRAMLPVLQGTSVTPAQAVLLLGRLLPRHDLLQLDSLALLANRRRYWELPWSEQQAQFLWKKMQVPTNLTLRNLQALGTLAGGMSCEFLQQINSMVDFLEVVHMIYQLPTRVRGSLRACIWAELQRRMAMPEPEWTTVGPELNGLDSKLLLDLPIQLMDRLSNESIMLVVELVQRAPEQLLALTPLHQAALAERALQNLAPKETPVSGEVLETLGPLVGFLGTESTRQIPLQILLSHLSQLQGFCLGETFATELGWLLLQESVLGKPELWSQDEVEQAGRLVFTLSTEAISLIPREALGPETLERLLEKQQSWEQSRVGQLCREPQLAAKKAALVAGVVRPAAEDLPEPVPNCADVRGTFPAAWSATQIAEMELSDFEDCLTLFAGDPGLGPEELRAAMGKAKQLWGPPRGFRPEQILQLGRLLIGLGDRELQELILVDWGVLSTLGQIDGWSTTQLRIVVSSFLRQSGRHVSHLDFVHLTALGYTLCGLRPEELQHISSWEFSQAALFLGTLHLQCSEEQLEVLAHLLVLPGGFGPISNWGPEIFTEIGTIAAGIPDLALSALLRGQIQGVTPLAISVIPPPKFAVVFSPIQLSSLTSAQAVAVTPEQMAFLSPEQRRAVAWAQHEGKESPEQQGRSTAWGLQDWSRPSWSLVLTISFLGHLL

SEQ ID NO: 65575 - protein, 629 aa, Homo sapiens
MFRDQVGVLAGWFKGWNECEQTVALLSLLKRVSQTQARFLQLCLEHSLADCAELHVLEREANSPGIINQWQQESKDKVISLLLTHLPLLKPGNLDAKVEYMKLLPKILAHSIEHNQHIEESRQLLSYALIHPATSLEDRSALAMWLNHLEDRTSTSFGGQNRGRSDSVDYGQTHYYHQRQNSDDKLNGWQNSRDSGICINASNWQDKSMGCENGHVPLYSSSSVPTTINTIGTSTSTNVPAWLKSLRLHKYAALFSQMTYEEMMALTECQLEAQNVTKGARHKIVISIQKLKERQNLLKSLERDIIEGGSLRIPLQELHQMILTPIKAYSSPSTTPEARRREPQAPRQPSLMGPESQSPDCKDGAAATGATATPSAGASGGLQPHQLSSCDGELAVAPLPEGDLPGQFTRVMGKVCTQLLVSRPDEENISSYLQLIDKCLIHEAFTETQKKRLLSWKQQVQKLFRSFPRKTLLDISGYRQQRNRGFGQSNSLPTAGSVGGGMGRRNPRQYQIPSRNVPSARLGLLGTSGFVSSNQRNTTATPTIMKQGRQNLWFANPGGSNSMPSRTHSSVQRTRSLPVHTSPQNMLMFQQPEFQLPVTEPDINNRLESLCLSMTEHALGDGVDRTSTI

SEQ ID NO: 65576 - protein, 630 aa, Homo sapiens
MMFRDQVGVLAGWFKGWNECEQTVALLSLLKRVSQTQARFLQLCLEHSLADCAELHVLEREANSPGIINQWQQESKDKVISLLLTHLPLLKPGNLDAKVEYMKLLPKILAHSIEHNQHIEESRQLLSYALIHPATSLEDRSALAMWLNHLEDRTSTSFGGQNRGRSDSVDYGQTHYYHQRQNSDDKLNGWQNSRDSGICINASNWQDKSMGCENGHVPLYSSSSVPTTINTIGTSTSTNVPAWLKSLRLHKYAALFSQMTYEEMMALTECQLEAQNVTKGARHKIVISIQKLKERQNLLKSLERDIIEGGSLRIPLQELHQMILTPIKAYSSPSTTPEARRREPQAPRQPSLMGPESQSPDCKDGAAATGATATPSAGASGGLQPHQLSSCDGELAVAPLPEGDLPGQFTRVMGKVCTQLLVSRPDEENISSYLQLIDKCLIHEAFTETQKKRLLSWKQQVQKLFRSFPRKTLLDISGYRQQRNRGFGQSNSLPTAGSVGGGMGRRNPRQYQIPSRNVPSARLGLLGTSGFVSSNQRNTTATPTIMKQGRQNLWFANPGGSNSMPSRTHSSVQRTRSLPVHTSPQNMLMFQQPEFQLPVTEPDINNRLESLCLSMTEHALGDGVDRTSTI

SEQ ID NO: 65577 - protein, 717 aa, Homo sapiens
MFRDQVGVLAGWFKGWNECEQTVALLSLLKRVSQTQARFLQLCLEHSLADCAELHVLEREANSPGIINQWQQESKDKVISLLLTHLPLLKPGNLDAKVEYMKLLPKILAHSIEHNQHIEESRQLLSYALIHPATSLEDRSALAMWLNHLEDRTSTSFGGQNRGRSDSVDYGQTHYYHQRQNSDDKLNGWQNSRDSGICINASNWQDKSMGCENGHVPLYSSSSVPTTINTIGTSTSTILSGQAHHSPLKRSVSLTPPMNVPNQPLGHGWMSHEDLRARGPQCLPSDHAPLSPQSSVASSGSGGSEHLEDQTTARNTFQEEGSGMKDVPAWLKSLRLHKYAALFSQMTYEEMMALTECQLEAQNVTKGARHKIVISIQKLKERQNLLKSLERDIIEGGSLRIPLQELHQMILTPIKAYSSPSTTPEARRREPQAPRQPSLMGPESQSPDCKDGAAATGATATPSAGASGGLQPHQLSSCDGELAVAPLPEGDLPGQFTRVMGKVCTQLLVSRPDEENISSYLQLIDKCLIHEAFTETQKKRLLSWKQQVQKLFRSFPRKTLLDISGYRQQRNRGFGQSNSLPTAGSVGGGMGRRNPRQYQIPSRNVPSARLGLLGTSGFVSSNQRNTTATPTIMKQGRQNLWFANPGGSNSMPSRTHSSVQRTRSLPVHTSPQNMLMFQQPEFQLPVTEPDINNRLESLCLSMTEHALGDGVDRTSTI

SEQ ID NO: 65578 - protein, 718 aa, Homo sapiens
MMFRDQVGVLAGWFKGWNECEQTVALLSLLKRVSQTQARFLQLCLEHSLADCAELHVLEREANSPGIINQWQQESKDKVISLLLTHLPLLKPGNLDAKVEYMKLLPKILAHSIEHNQHIEESRQLLSYALIHPATSLEDRSALAMWLNHLEDRTSTSFGGQNRGRSDSVDYGQTHYYHQRQNSDDKLNGWQNSRDSGICINASNWQDKSMGCENGHVPLYSSSSVPTTINTIGTSTSTILSGQAHHSPLKRSVSLTPPMNVPNQPLGHGWMSHEDLRARGPQCLPSDHAPLSPQSSVASSGSGGSEHLEDQTTARNTFQEEGSGMKDVPAWLKSLRLHKYAALFSQMTYEEMMALTECQLEAQNVTKGARHKIVISIQKLKERQNLLKSLERDIIEGGSLRIPLQELHQMILTPIKAYSSPSTTPEARRREPQAPRQPSLMGPESQSPDCKDGAAATGATATPSAGASGGLQPHQLSSCDGELAVAPLPEGDLPGQFTRVMGKVCTQLLVSRPDEENISSYLQLIDKCLIHEAFTETQKKRLLSWKQQVQKLFRSFPRKTLLDISGYRQQRNRGFGQSNSLPTAGSVGGGMGRRNPRQYQIPSRNVPSARLGLLGTSGFVSSNQRNTTATPTIMKQGRQNLWFANPGGSNSMPSRTHSSVQRTRSLPVHTSPQNMLMFQQPEFQLPVTEPDINNRLESLCLSMTEHALGDGVDRTSTI

SEQ ID NO: 65579 - protein, 718 aa, Homo sapiens; identical to SEQ ID NO: 65578

SEQ ID NO: 65580 - protein, 345 aa, Homo sapiens
MILTPIKAYSSPSTTPEARRREPQAPRQPSLMGPESQSPDCKDGAAATGATATPSAGASGGLQPHQLSSCDGELAVAPLPEGDLPGQFTRVMGKVCTQLLVSRPDEENISSYLQLIDKCLIHEAFTETQKKRLLSWKQQVQKLFRSFPRKTLLDISGYRQQRNRGFGQSNSLPTAGSVGGGMGRRNPRQYQIPSRNVPSARLGLLGTSGFVSSNQRNTTATPTIMKQGRQNLWFANPGGSNSMPSRTHSSVQRTRSLPVHTSPQNMLMFQQPGSQVHSGLCLTDLRGWLSLSGAPSMPALTVPKSSQGEFQLPVTEPDINNRLESLCLSMTEHALGDGVDRTSTI

SEQ ID NO: 65581 - protein, 326 aa, Homo sapiens
MAGPNQLCIRRWTTKHVAVWLKDEGFFEYVDILCNKHRLDGITLLTLTEYDLRSPPLEIKVLGDIKRLMLSVRKLQKIHIDVLEEMGYNSDSPMGSMTPFISALQSTDWLCNGELSHDCDGPITDLNSDQYQYMNGKNKHSVRRLDPEYWKTILSCIYVFIVFGFTSFIMVIVHERVPDMQTYPPLPDIFLDSVPRIPWAFAMTEVCGMILCYIWLLVLLLHKHRSILLRRLCSLMGTVFLLRCFTMFVTSLSVPGQHLQCTGKIYGSVWEKLHRAFAIWSGFGMTLTGVHTCGDYMFSGHTVVLTMLNFFVTECKYLFSASMRIR

SEQ ID NO: 65582 - protein, 478 aa, Homo sapiens
MPARSRHRPRLHSGSPPRAPPPPLEALHSGEAGRAPDSDGGSDADSEVGPGSPTRTAEAAEEEMAGPNQLCIRRWTTKHVAVWLKDEGFFEYVDILCNKHRLDGITLLTLTEYDLRSPPLEIKVLGDIKRLMLSVRKLQKIHIDVLEEMGYNSDSPMGSMTPFISALQSTDWLCNGELSHDCDGPITDLNSDQYQYMNGKNKHSVRRLDPEYWKTILSCIYVFIVFGFTSFIMVIVHERVPDMQTYPPLPDIFLDSVPRIPWAFAMTEVCGMILCYIWLLVLLLHKHRSILLRRLCSLMGTVFLLRCFTMFVTSLSVPGQHLQCTGKIYGSVWEKLHRAFAIWSGFGMTLTGVHTCGDYMFSGHTVVLTMLNFFVTEYTPRSWNFLHTLSWVLNLFGIFFILAAHEHYSIDVFIAFYITTRLFLYYHTLANTRAYQQSRRARIWFPMFSFFECNVNGTVPNEYCWPFSKPAIMKRLIG

SEQ ID NO: 65583 - protein, 254 aa, Homo sapiens
MAGPNQLCIRRWTTKHVAVWLKDEGFFEYVDILCNKHRLDGITLLTLTEYDLRSPPLEIKVLGDIKRLMLSVRKLQKIHIDVLEEMGYNSDSPMGSMTPFISALQSTDWLCNGELSHDCDGPITDLNSDQYQYMNGKNKHSVRRLDPEYWKTILSCIYVFIVFGFTSFIMVIVHERVPDMQTYPPLPDIFLDSVPRIPWAFAMTEVCGMILCYIWLLVLLLHKHRSILLRRLCSLMGTVFLLRCFTMFVTSLSV

SEQ ID NO: 65584 - protein, 415 aa, Homo sapiens
MAGPNQLCIRRWTTKHVAVWLKDEGFFEYVDILCNKHRLDGITLLTLTEYDLRSPPLEIKVLGDIKRLMLSVRKLQKIHIDVLEEMGYNSDSPMGSMTPFISALQSTDWLCNGELSHDCDGPITDLNSDQYQYMNGKNKHSVRRLDPEYWKTILSCIYVFIVFGFTSFIMVIVHERVPDMQTYPPLPDIFLDSVPRIPWAFAMTEVCGMILCYIWLLVLLLHKHRSILLRRLCSLMGTVFLLRCFTMFVTSLSVPGQHLQCTGKIYGSVWEKLHRAFAIWSGFGMTLTGVHTCGDYMFSGHTVVLTMLNFFVTEYTPRSWNFLHTLSWVLNLFGIFFILAAHEHYSIDVFIAFYITTRLFLYYHTLANTRAYQQSRRARIWFPMFSFFECNVNGTVPNEYCWPFSKPAIMKRLIG

SEQ ID NO: 65585 - protein, 1589 aa, Homo sapiens
MAKQLNLPENTDDWTKEDVNQWLESHKIDQKHREILTEQDVNGAVLKWLKKEHLVDMGITHGPAIQIEELFKELRKTAIEDSIQTSKMGKPSKNAPKDQTVSQKERRETSKQKQKGKENPDMANPSAMSTTAKGSKSLKVELIEDKIDYTKERQPSIDLTCVSYPFDEFSNPYRYKLDFSLQPETGPGNLIDPIHEFKAFTNTATATEEDVKMKFSNEVFRFASACMNSRTNGTIHFGVKDKPHGKIVGIKVTNDTKEALINHFNLMINKYFEDHQVQQAKKCIREPRFVEVLLPNSTLSDRFVIEVDIIPQFSECQYDYFQIKMQNYNNKIWEQSKKFSLFVRDGTSSKDITKNKVDFRAFKADFKTLAESRKAAEEKFRAKTNKKEREGPKLVKLLTGNQDLLDNSYYEQYILVTNKCHPDQTKHLDFLKEIKWFAVLEFDPESNINGVVKAYKESRVANLHFPSVYVEQKTTPNETISTLNLYHQPSWIFCNGRLDLDSEKYKPFDPSSWQRERASDVRKLISFLTHEDIMPRGKFLVVFLLLSSVDDPRDPLIETFCAFYQDLKGMENILCICVHPHIFQGWKDLLEARLIKHQDEISSQCISALSLEEINGTILKLKSVTQSSKRLLPSIGLSTVLLKKEEDIMTALEIICENECEGTLLEKDKNKFLEFKASKEEDFYRGGKVSWWNFYFSSESYSSPFVKRDKYERLEAMIQNCADSSKPTSTKIIHLYHHPGCGGTTLAMHILWELRKKFRCAVLKNKTVDFSEIGEQVTSLITYGAMNRQEYVPVLLLVDDFEEQDNVYLLQYSIQTAIAKKYIRYEKPLVIILNCMRSQNPEKSARIPDSIAVIQQLSPKEQRAFELKLKEIKEQHKNFEDFYSFMIMKTNFNKEYIENVVRNILKGQNIFTKEAKLFSFLALLNSYVPDTTISLSQCEKFLGIGNKKAFWGTEKFEDKMGTYSTILIKTEVIECGNYCGVRIIHSLIAEFSLEELKKSYHLNKSQIMLDMLTENLFFDTGMGKSKFLQDMHTLLLTRHRDEHEGETGNWFSPFIEALHKDEGNEAVEAVLLESIHRFNPNAFICQALARHFYIKKKDFGNALNWAKQAKIIEPDNSYISDTLGQVYKSKIRWWIEENGGNGNISVDDLIALLDLAEHASSAFKESQQQSEDREYEVKERLYPKSKRRYDTYNIAGYQGEIEVGLYTIQILQLIPFFDNKNELSKRYMVNFVSGSSDIPGDPNNEYKLALKNYIPYLTKLKFSLKKSFDFFDEYFVLLKPRNNIKQNEEAKTRRKVAGYFKKYVDIFCLLEESQNNTGLGSKFSEPLQVERCRRNLVALKADKFSGLLEYLIKSQEDAISTMKCIVNEYTFLLEQCTVKIQSKEKLNFILANIILSCIQPTSRLVKPVEKLKDQLREVLQPIGLTYQFSEPYFLASLLFWPENQQLDQHSEQMKEYAQALKNSFKGQYKHMHRTKQPIAYFFLGKGKRLERLVHKGKIDQCFKKTPDINSLWQSGDVWKEEKVQELLLRLQGRAENNCLYIEYGINEKITIPITPAFLGQLRSGRSIEKVSFYLGFSIGGPLAYDIEIV

SEQ ID NO: 65586 - protein, 1283 aa, Homo sapiens
MAKQLNLPENTDDWTKEDVNQWLESHKIDQKHREILTEQDVNGAVLKWLKKEHLVDMGITHGPAIQIEELFKELRKTAIEDSIQTSKMGKPSKNAPKDQTVSQKERRETSKQKQKGKENPDMANPSAMSTTAKGSKSLKVELIEDKIDYTKERQPSIDLTCVSYPFDEFSNPYRYKLDFSLQPETGPGNLIDPIHEFKAFTNTATATEEDVKMKFSNEVFRFASACMNSRTNGTIHFGVKDKPHGKIVGIKVTNDTKEALINHFNLMINKYFEDHQVQQAKKCIREPRFVEVLLPNSTLSDRFVIEVDIIPQFSECQYDYFQIKMQNYNNKIWEQSKKFSLFVRDGTSSKDITKNKVDFRAFKADFKTLAESRKAAEEKFRAKTNKKEREGPKLVKLLTGNQDLLDNSYYEQYILVTNKCHPDQTKHLDFLKEIKWFAVLEFDPESNINGVVKAYKESRVANLHFPSVYVEQKTTPNETISTLNLYHQPSWIFCNGRLDLDSEKYKPFDPSSWQRERASDVRKLISFLTHEDIMPRGKFLVVFLLLSSVDDPRDPLIETFCAFYQDLKGMENILCICVHPHIFQGWKDLLEARLIKHQDEISSQCISALSLEEINGTILKLKSVTQSSKRLLPSIGLSTVLLKKEEDIMTALEIICENECEGTLLEKDKNKFLEFKASKEEDFYRGGKVSWWNFYFSSESYSSPFVKRDKYERLEAMIQNCADSSKPTSTKIIHLYHHPGCGGTTLAMHILWELRKKFRCAVLKNKTVDFSEIGEQVTSLITYGAMNRQEYVPVLLLVDDFEEQDNVYLLQYSIQTAIAKKYIRYEKPLVIILNCMRSQNPEKSARIPDSIAVIQQLSPKEQRAFELKLKEIKEQHKNFEDFYSFMIMKTNFNKEYIENVVRNILKGQNIFTKEAKLFSFLALLNSYVPDTTISLSQCEKFLGIGNKKAFWGTEKFEDKMGTYSTILIKTEVIECGNYCGVRIIHSLIAEFSLEELKKSYHLNKSQIMLDMLTENLFFDTGMGKSKFLQDMHTLLLTRHRDEHEGETGNWFSPFIEALHKDEGNEAVEAVLLESIHRFNPNAFICQALARHFYIKKKDFGNALNWAKQAKIIEPDNSYISDTLGQVYKSKIRWWIEENGGNGNISVDDLIALLDLAEHASSAFKESQQQSEDREYEVKERLYPKSKRRYDTYNIAGYQGEIEVGLYTIQILQLIPFFDNKNELSKRYMVNFVSGSSDIPGDPNNEYKLALKNYIPYLTKLKFSLKKSFDFFDEYFVLLKPRNN

SEQ ID NO: 65587 - protein, 1584 aa, Homo sapiens
MSKQVSLPEMIKDWTKEHVKKWVNEDLKINEQYGQILLSEEVTGLVLQELTEKDLVEMGLPWGPALLIKRSYNKLNSKSPESDNHDPGQLDNSKPSKTEHQKNPKHTKKEEENSMSSNIDYDPREIRDIKQEESILMKENVLDEVANAKHKKKGKLKPEQLTCMPYPFDQFHDSHRYIEHYTLQPETGALNLIDPIHEFKALTNTETATEVDIKMKFSNEVFRFASACMNSRTNGTIHFGVKDKPHGEIVGVKITSKAAFIDHFNVMIKKYFEESEINEAKKCIREPRFVEVLLQNNTPSDRFVIEVDTIPKHSICNDKYFYIQMQICKDKIWKQNQNLSLFVREGASSRDILANSKQRDVDFKAFLQNLKSLVASRKEAEEEYGMKAMKKESEGLKLVKLLIGNRDSLDNSYYDWYILVTNKCHPNQIKHLDFLKEIKWFAVLEFDPESMINGVVKAYKESRVANLHFPNQYEDKTTNMWEKISTLNLYQQPSWIFCNGRSDLKSETYKPLEPHLWQRERASEVRKLILFLTDENIMTRGKFLVVFLLLSSVESPGDPLIETFWAFYQALKGMENMLCISVNSHIYQRWKDLLQTRMKMEDELTNHSISTLNIELVNSTILKLKSVTRSSRRFLPARGSSSVILEKKKEDVLTALEILCENECTETDIEKDKSKFLEFKKSKEEHFYRGGKVSWWNFYFSSENYSSDFVKRDSYEKLKDLIHCWAESPKPIFAKIINLYHHPGCGGTTLAMHVLWDLKKNFRCAVLKNKTTDFAEIAEQVINLVTYRAKSHQDYIPVLLLVDDFEEQENVYFLQNAIHSVLAEKDLRYEKTLVIILNCMRSRNPDESAKLADSIALNYQLSSKEQRAFGAKLKEIEKQHKNCENFYSFMIMKSNFDETYIENVVRNILKGQDVDSKEAQLISFLALLSSYVTDSTISVSQCEIFLGIIYTSTPWEPESLEDKMGTYSTLLIKTEVAEYGRYTGVRIIHPLIALYCLKELERSYHLDKCQIALNILEENLFYDSGIGRDKFQHDVQTLLLTRQRKVYGDETDTLFSPLMEALQNKDIEKVLSAGSRRFPQNAFICQALARHFYIKEKDFNTALDWARQAKMKAPKNSYISDTLGQVYKSEIKWWLDGNKNCRSITVNDLTHLLEAAEKASRAFKESQRQTDSKNYETENWSPQKSQRRYDMYNTACFLGEIEVGLYTIQILQLTPFFHKENELSKKHMVQFLSGKWTIPPDPRNECYLALSKFTSHLKNLQSDLKRCFDFFIDYMVLLKMRYTQKEIAEIMLSKKVSRCFRKYTELFCHLDPCLLQSKESQLLQEENCRKKLEALRADRFAGLLEYLNPNYKDATTMESIVNEYAFLLQQNSKKPMTNEKQNSILANIILSCLKPNSKLIQPLTTLKKQLREVLQFVGLSHQYPGPYFLACLLFWPENQELDQDSKLIEKYVSSLNRSFRGQYKRMCRSKQASTLFYLGKRKGLNSIVHKAKIEQYFDKAQNTNSLWHSGDVWKKNEVKDLLRRLTGQAEGKLISVEYGTEEKIKIPVISVYSGPLRSGRNIERVSFYLGFSIEGPLAYDIEVI

SEQ ID NO: 65588 - protein, 406 aa, Homo sapiens
MSKQVSLPEMIKDWTKEHVKKWVNEDLKINEQYGQILLSEEVTGLVLQELTEKDLVEMGLPWGPALLIKRSYNKLNSKSPESDNHDPGQLDNSKPSKTEHQKNPKHTKKEEENSMSSNIDYDPREIRDIKQEESILMKENVLDEVANAKHKKKLEALRADRFAGLLEYLNPNYKDATTMESIVNEYAFLLQQNSKKPMTNEKQNSILANIILSCLKPNSKLIQPLTTLKKQLREVLQFVGLSHQYPGPYFLACLLFWPENQELDQDSKLIEKYVSSLNRSFRGQYKRMCRSKQASTLFYLGKRKGLNSIVHKAKIEQYFDKAQNTNSLWHSGDVWKKNEVKDLLRRLTGQAEGKLISVEYGTEEKIKIPVISVYSGPLRSGRNIERVSFYLGFSIEGPLAYDIEVI

SEQ ID NO: 65589 - protein, 1584 aa, Homo sapiens; identical to SEQ ID NO: 65587

SEQ ID NO: 65590 - protein, 70 aa, Homo sapiens
MSKQVSLPEMIKDWTKEHVKKWVNEDLKINEQYGQILLSEEVTGLVLQELTEKDLVEMGLPWGPALLIKR

SEQ ID NO: 65591 - protein, 1584 aa, Homo sapiens; identical to SEQ ID NO: 65587

SEQ ID NO: 65592 - protein, 70 aa, Homo sapiens; identical to SEQ ID NO: 65590

SEQ ID NO: 65593 - protein, 70 aa, Homo sapiens; identical to SEQ ID NO: 65590

SEQ ID NO: 65594 - protein, 70 aa, Homo sapiens; identical to SEQ ID NO: 65590

SEQ ID NO: 65595 - protein, 318 aa, Homo sapiens
MAPWAEAEHSALNPLRAVWLTLTAAFLLTLLLQLLPPGLLPGCAIFQDLIRYGKTKCGEPSRPAACRAFDVPKRYFSHFYIISVLWNGFLLWCLTQSLFLGAPFPSWLHGLLRILGAAQFQGGELALSAFLVLVFLWLHSLRRLFECLYVSVFSNVMIHVVQYCFGLVYYVLVGLTVLSQVPMDGRNAYITGKNLLMQARWFHILGMMMFIWSSAHQYKCHVILGNLRKNKAGVVIHCNHRIPFGDWFEYVSSPNYLAELMIYVSMAVTFGFHNLTWWLVVTNVFFNQALSAFLSHQFYKSKFVSYPKHRKAFLPFLF

SEQ ID NO: 65596 - protein, 236 aa, Homo sapiens
MTRCPAGQAEVEMAELYVKPGNKERGWNDPPQFSYGLQTQAGGPRRSLLTKRVAAPQDGSPRVPASETSPGPPPMGPPPPSSKAPRSPPVGSGPASGVEPTSFPVESEAVMEDVLRPLEQALEDCRGHTRKQVCDDISRRLALLQEQWAGGKLSIPVKKRMALLVQELSSHRWDAADDIHRSLMVDHVTEVSQWMVGVKRLIAEKRSLFSEEAANEEKSAATAEKNHTIPGFQQAS

SEQ ID NO: 65597 - protein, 583 aa, Homo sapiens
MPLRKMKIPFLLLFFLWEAESHAASRPNIILVMADDLGIGDPGCYGNKTIRTPNIDRLASGGVKLTQHLAASPLCTPSRAAFMTGRYPVRSGMASWSRTGVFLFTASSGGLPTDEITFAKLLKDQGYSTALIGKWHLGMSCHSKTDFCHHPLHHGFNYFYGISLTNLRDCKPGEGSVFTTGFKRLVFLPLQIVGVTLLTLAALNCLGLLHVPLGVFFSLLFLAALILTLFLGFLHYFRPLNCFMMRNYEIIQQPMSYDNLTQRLTVEAAQFIQRNTETPFLLVLSYLHVHTALFSSKDFAGKSQHGVYGDAVEEMDWSVGQILNLLDELRLANDTLIYFTSDQGAHVEEVSSKGEIHGGSNGIYKGGKANNWEGGIRVPGILRWPRVIQAGQKIDEPTSNMDIFPTVAKLAGAPLPEDRIIDGRDLMPLLEGKSQRSDHEFLFHYCNAYLNAVRWHPQNSTSIWKAFFFTPNFNPVGSNGCFATHVCFCFGSYVTHHDPPLLFDISKDPRERNPLTPASEPRFYEILKVMQEAADRHTQTLPEVPDQFSWNNFLWKPWLQLCCPSTGLSCQCDREKQDKRLSR

SEQ ID NO: 65598 - protein, 259 aa, Homo sapiens
MATATGVAEERLLAALAYLQCAVGCAVFARNRQTNSVYGRHALPSHRLRVPARAAWVVQELPSLALPLYQYASESAPRLRSAPNCILLAMFLVHYGHRCLIYPFLMRGGKPMPLLACTMAIMFCTCNGYLQSRYLSHCAVYADDWVTDPRFLIGFGLWLTGMLINIHSDHILRNLRKPGDTGYKIPRGGLFEYVTAANYFGEIMEWCGYALASWSVQGAAFAFFTFCFLSGRAKEHHEWYLRKFEEYPKFRKIIIPFLF

SEQ ID NO: 65599 - protein, 194 aa, Homo sapiens
MEHAAQPWRWQRRRGWRRSACWPRSPTCSAPWAARSSRAIVRRTQCTAATRCPATGSECRRGPPGWCRSCPRWPCRSTSTPASPPRVSAARPTASSWPCSSSTTGIGNVGMQALAVCLHPKCQPMVPIVCPDLNHDSKTQREIAGIRCSYSLLGNTAASRRIPTSLMTQHLNAHLLANTCFAVNQYEVFLGVLA

SEQ ID NO: 65600 - protein, 212 aa, Homo sapiens
MEHAAQPWRWQRRRGWRRSACWPRSPTCSAPWAARSSRAIVRRTQCTAATRCPATGSECRRGPPGWCRSCPRWPCRSTSTPASPPRVSAARPTASSWPCSSSTTGIGFGLWLTGMLINIHSDHILRNLRKPGDTGYKIPRGGLFEYVTAANYFGEIMEWCGYALASWSVQGAAFAFFTFCFLSGRAKEHHEWYLRKFEEYPKFRKIIIPFLF

SEQ ID NO: 65601 - protein, 285 aa, Homo sapiens
MLLATFKLCAGSSYRHMRNMKGLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEVVVDQPMERLYEELVERMEAMGEWNPNVKEIKVLQKIGKDTFITHELAAEAAGNLVGPRDFVSVRCAKRRGSTCVLAGMATDFGNMPEQKGVIRAEHGPTCMVLHPLAGSPSKTKLTWLLSIDLKGWLPKSIINQVLSQTQVDFANHLRKRLESHPASEARC

SEQ ID NO: 65602 - protein, 247 aa, Homo sapiens
MLLATFKLCAGSSYRHMRNMKGSRLEETLYSDQELAYLQQGEEAMQKALGILSNQEGWKKESQQDNGDKVMSKVVPDVGKVFRLEVVVDQPMERLYEELVERMEAMGEWNPNVKEIKVLQKIGKDTFITHELAAEAAGNLVGPRDFVSVRCAKRRGSTCVLAGMATDFGNMPEQKGVIRAEHGPTCMVLHPLAGSPSKTKLTWLLSIDLKGWLPKSIINQVLSQTQVDFANHLRKRLESHPASEARC

SEQ ID NO: 65603 - protein, 322 aa, Homo sapiens
MSSSPWEPATLRRVFVVGVGMTKFVKPGAENSRDYPDLAEEAGKKALADAQIPYSAVDQACVGYVFGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGGHSCS

SEQ ID NO: 65604 - protein, 547 aa, Homo sapiens
MSSSPWEPATLRRVFVVGVGMTKFVKPGAENSRDYPDLAEEAGKKALADAQIPYSAVDQACVGYVFGDSTCGQRAIYHSLGMTGIPIINVNNNCATGSTALFMARQLIQGGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGLAQCAELCWQLRGEAGKRQVPGAKVALQHNLGIGGAVVVTLYKMGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 65605 - protein, 523 aa, Homo sapiens
MSSSPWEPATLRRVFVVGVGMTKFVKPGAENSRDYPDLAEEAGDSTCGQRAIYHSLGMTGIPIINVNNNCATGSTALFMARQLIQGGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGLAQCAELCWQLRGEAGKRQVPGAKVALQHNLGIGGAVVVTLYKMGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 65606 - protein, 59 aa, Homo sapiens
MGFPEAASSFRTHQIEAVPTSSASDGFKANLVFKEIEKKLEEIRRLTAQSQWLTQTSWL

SEQ ID NO: 65607 - protein, 140 aa, Homo sapiens
MGFPEAARTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 65608 - protein, 143 aa, Homo sapiens
MGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 65609 - protein, 59 aa, Homo sapiens; identical to SEQ ID NO: 65606

SEQ ID NO: 65610 - protein, 466 aa, Homo sapiens
MTGIPIINVNNNCATGSTALFMARQLIQGGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGLAQCAELCWQLRGEAGKRQVPGAKVALQHNLGIGGAVVVTLYKMGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 65611 - protein, 503 aa, Homo sapiens
MSSSPWEPATLRRVFVVGVGMTKFVKPGAENSRDYPDLAEEAGKKALADAQIPYSAVDQACVGYVFGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGLAQCAELCWQLRGEAGKRQVPGAKVALQHNLGIGGAVVVTLYKMGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 65612 - protein, 550 aa, Homo sapiens
MVGEEKMSLRNRLSKSRENPEEDEDQRNPAKESLETPSNGRIDIKQLIAKKIKLTAEAEELKPFFMKEVGSHFDDFVTNLIEKSASLDNGGCALTTFSVLEGEKNNHRAKDLRAPPEQGKIFIARRSLLDELLEVDHIRTIYHMFIALLILFILSTLVVDYIDEGRLVLEFSLLSYAFGKFPTVVWTWWIMFLSTFSVPYFLFQHWATGYSKSSHPLIRSLFHGFLFMIFQIGVLGFGPTYVVLAYTLPPASRFIIIFEQIRFVMKAHSFVRENVPRVLNSAKEKSSTVPIPTVNQYLYFLFAPTLIYRDSYPRNPTVRWGYVAMKFAQVFGCFFYVYYIFERLCAPLFRNIKQEPFSARVLVLCVFNSILPGVLILFLTFFAFLHCWLNAFAEMLRFGDRMFYKDWWNSTSYSNYYRTWNVVVHDWLYYYAYKDFLWFFSKRFKSAAMLAVFAVSAVVHEYALAVCLSFFYPVLFVLFMFFGMAFNFIVNDSRKKPIWNVLMWTSLFLGNGVLLCFYSQEWYARQHCPLKNPTFLDYVRPRSWTCRYVF

SEQ ID NO: 65613 - protein, 260 aa, Homo sapiens
MVGEEKMSLRNRLSKSRENPEEDEDQRNPAKESLETPSNGRIDIKQLIAKKIKLTAEAEELKPFFMKEVGSHFDDFVTNLIEKSASLDNGGCALTTFSVLEGEKNNHRAKDLRAPPEQGKIFIARRSLLDELLEVDHIRTIYHMFIALLILFILSTLVVDYIDEGRLVLEFSLLSYAFGKFPTVVWTWWIMFLSTFSVPYFLFQHWATGYSKSSHPLIRSLFHGFLFMIFQIGVLGFGPTYVVLAYTLPPASRFIIIFEQ

SEQ ID NO: 65614 - protein, 286 aa, Homo sapiens
MKAHSFVRENVPRVLNSAKEKSSTVPIPTVNQYLYFLFAPTLIYRDSYPRNPTVRWGYVAMKFAQVFGCFFYVYYIFERLCAPLFRNIKQEPFSARVLVLCVFNSILPGVLILFLTFFAFLHCWLNAFAEMLRFGDRMFYKDWWNSTSYSNYYRTWNVVVHDWLYYYAYKDFLWFFSKRFKSAAMLAVFAVSAVVHEYALAVCLSFFYPVLFVLFMFFGMAFNFIVNDSRKKPIWNVLMWTSLFLGNGVLLCFYSQEWYARQHCPLKNPTFLDYVRPRSWTCRYVF

SEQ ID NO: 65615 - protein, 485 aa, Homo sapiens
MKEVGSHFDDFVTNLIEKSASLDNGGCALTTFSVLEGEKNNHRAKDLRAPPEQGKIFIARRSLLDELLEVDHIRTIYHMFIALLILFILSTLVVDYIDEGRLVLEFSLLSYAFGKFPTVVWTWWIMFLSTFSVPYFLFQHWATGYSKSSHPLIRSLFHGFLFMIFQIGVLGFGPTYVVLAYTLPPASRFIIIFEQIRFVMKAHSFVRENVPRVLNSAKEKSSTVPIPTVNQYLYFLFAPTLIYRDSYPRNPTVRWGYVAMKFAQVFGCFFYVYYIFERLCAPLFRNIKQEPFSARVLVLCVFNSILPGVLILFLTFFAFLHCWLNAFAEMLRFGDRMFYKDWWNSTSYSNYYRTWNVVVHDWLYYYAYKDFLWFFSKRFKSAAMLAVFAVSAVVHEYALAVCLSFFYPVLFVLFMFFGMAFNFIVNDSRKKPIWNVLMWTSLFLGNGVLLCFYSQEWYARQHCPLKNPTFLDYVRPRSWTCRYVF

SEQ ID NO: 65616 - protein, 492 aa, Homo sapiens
MELKPFFMKEVGSHFDDFVTNLIEKSASLDNGGCALTTFSVLEGEKNNHRAKDLRAPPEQGKIFIARRSLLDELLEVDHIRTIYHMFIALLILFILSTLVVDYIDEGRLVLEFSLLSYAFGKFPTVVWTWWIMFLSTFSVPYFLFQHWATGYSKSSHPLIRSLFHGFLFMIFQIGVLGFGPTYVVLAYTLPPASRFIIIFEQIRFVMKAHSFVRENVPRVLNSAKEKSSTVPIPTVNQYLYFLFAPTLIYRDSYPRNPTVRWGYVAMKFAQVFGCFFYVYYIFERLCAPLFRNIKQEPFSARVLVLCVFNSILPGVLILFLTFFAFLHCWLNAFAEMLRFGDRMFYKDWWNSTSYSNYYRTWNVVVHDWLYYYAYKDFLWFFSKRFKSAAMLAVFAVSAVVHEYALAVCLSFFYPVLFVLFMFFGMAFNFIVNDSRKKPIWNVLMWTSLFLGNGVLLCFYSQEWYARQHCPLKNPTFLDYVRPRSWTCRYVF

SEQ ID NO: 65617 - protein, 522 aa, Homo sapiens
MEPGGARLRLQRTEGLGGERERQPCGDGNTETHRAPDLVQWTRHMEAVKAQLLEQAQGQLRELLDRAMREAIQSYPSQDKPLPPPPPGSLSRTQEPSLGKQKVFIIRKSLLDELMEVQHFRTIYHMFIAGLCVFIISTLAIDFIDEGRLLLEFDLLIFSFGQLPLALVTWVPMFLSTLLAPYQALRLWARGTWTQATGLGCALLAAHAVVLCALPVHVAVEHQLPPASRCVLVFEQVRFLMKSYSFLREAVPGTLRARRGEGIQAPSFSSYLYFLFCPTLIYRETYPRTPYVRWNYVAKNFAQALGCVLYACFILGRLCVPVFANMSREPFSTRALVLSILHATLPGIFMLLLIFFAFLHCWLNAFAEMLRFGDRMFYRDWWNSTSFSNYYRTWNVVVHDWLYSYVYQDGLRLLGARARGVAMLGVFLVSAVAHEYIFCFVLGFFYPVMLILFLVIGGMLNFMMHDQRTGPAWNVLMWTMLFLGQGIQVSLYCQEWYARRHCPLPQATFWGLVTPRSWSCHT

SEQ ID NO: 65618 - protein, 1141 aa, Homo sapiens
MDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 65619 - protein, 684 aa, Homo sapiens
MDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGVYGKKSGATHSIEEELNIHISRGTRTRTLLSSRRFCSCCRQPTNLPGSFGPGTAHLPPGPGLQPLLERDPLQPAEATPGALAAQESLPVPAGHASH

SEQ ID NO: 65620 - protein, 1102 aa, Homo sapiens
MDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLPCLQPS

SEQ ID NO: 65621 - protein, 215 aa, Homo sapiens
MHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 65622 - protein, 299 aa, Homo sapiens
MDLVLRVADYYFFTPYVYPATWPEDDIFRQAISLLIVTNVGAYILYFFCATLSYYFVFDHALMKHPQFLKNQVRREIKFTVQALPWISILTVALFLLEIRGYSKLHDDLGEFPYGLFELVVSIISFLFFTDMFIYWIHRGLHHRLVYKRLHKPHHIWKIPTPFASHAFHPIDGFLQSLPYHIYPFIFPLHKVVYLSLYILVNIWTISIHDGDFRVPQILQPFINGSAHHTDHHMFFDYNYGQYFTLWDRIGGSFKNPSSFEGKGPLSYVKEMTEGKRSSHSGNGCKNEKLFNGEFTKTE

SEQ ID NO: 65623 - protein, 299 aa, Homo sapiens; identical to SEQ ID NO: 65622

SEQ ID NO: 65624 - protein, 63 aa, Homo sapiens
MEGAGAGSGFRKELVSRLLHLHFKDDKTKEAAVRGVRQAQAEDALRVDVDQLEKVLPQLLLDF

SEQ ID NO: 65625 - protein, 81 aa, Homo sapiens
MEGAGAGSGFRKELVSRLLHLHFKDDKTKVSGDALQLMVELLKVFVVEAAVRGVRQAQAEDALRVDVDQLEKVLPQLLLDF

SEQ ID NO: 65626 - protein, 706 aa, Homo sapiens
MGGKGGGDTRGPVLFPCQLAQALSPRRAFPRELKEKGQRMSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 65627 - protein, 667 aa, Homo sapiens
MSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 65628 - protein, 667 aa, Homo sapiens; identical to SEQ ID NO: 65627

SEQ ID NO: 65629 - protein, 599 aa, Homo sapiens
MLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 65630 - protein, 658 aa, Homo sapiens
MSSQPAGNQTSPGATEDYSYGSWYIDEPQGGEELQPEGEVPSCHTSIPPGLYHACLASLSILVLLLLAMLVRRRQLWPDCVRGRPGLPRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 65631 - protein, 159 aa, Homo sapiens
MSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGNLPKITELRLVRAWI

SEQ ID NO: 65632 - protein, 706 aa, Homo sapiens; identical to SEQ ID NO: 65626

SEQ ID NO: 65633 - protein, 704 aa, Homo sapiens
MQIRLLRAELVVPLWQFIRQWPPGSDGWGQMEEKGQRMSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 65634 - protein, 557 aa, Homo sapiens
MAAGTSMSPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 65635 - protein, 476 aa, Homo sapiens
MGKLRLQEIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 65636 - protein, 330 aa, Homo sapiens
MGKIDVDKILFFNQEIRLWQLIMATPEENSNPHDRATPQLPAQLQELEHRVARRRLSQARHRATLAALFNNLRKTVYSQSDLIASKWQVLNKAKSHIPELEQTLDNLLKLKASFNLEDGHASSLEEVKKEYASMYSGNDSFPQNGSSPWYLNFYKQTMDLLTGSGIITPQEAALPIVSAAISHLWQNLSEERKASLRQAWAQKHRGPATLAEACREPACAEGSVKDSGVDSQGASCSLVSTPEEILFEDAFDVASFLDKSEVPSTSSSSSVLASCNPENPEEKFQLYMQIINFFKGLSCANTQVKQEASFPVDEEMIMLQCTETFDDEDL

SEQ ID NO: 65637 - protein, 303 aa, Homo sapiens
MKGKEEKEGGARLGAGGGSPEKSPSAQELKEQGNRLFVGRKYPEAAACYGRAITRNPLVAVYYTNRALCYLKMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 65638 - protein, 398 aa, Homo sapiens
MLGRSGYRALPLGDFDRFQQSSFGFLGSQKGCLSPERGGVGTGADVPQSWPSCLCHGLISFLGFLLLLVTFPISGWFALKIVPTYERMIVFRLGRIRTPQGPGMVLLLPFIDSFQRVDLRTRAFNVPPCKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPADTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 65639 - protein, 348 aa, Homo sapiens
MLGRSGYRALPLGDFDRFQQSSFGFLGSQKGCLSPERGGVGTGADVPQSWPSCLCHGLISFLGFLLLLVTFPISGWFALKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPADTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 65640 - protein, 327 aa, Homo sapiens
MLGRSGYRALPLGDFDRFQQSSFGFLGSQKGCLSPERGGVGTGADVPQSWPSCLCHGLISFLGFLLLLVTFPISGWFALKIVPTYERMIVFRLGRIRTPQGPGMVLLLPFIDSFQRVDLRTRAFNVPPCKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPGRGRVGHGVPDGIPDVVVEMAEADLRALLCRELRPLGAYMSGRLKVKGDLAMAMKLEAVLRALK

SEQ ID NO: 65641 - protein, 355 aa, Homo sapiens
MPDVPQSWPSCLCHGLISFLGFLLLLVTFPISGWFALKIVPTYERMIVFRLGRIRTPQGPGMVLLLPFIDSFQRVDLRTRAFNVPPCKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPDTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 65642 - protein, 310 aa, Homo sapiens
MIVFRLGRIRTPQGPGMVLLLPFIDSFQRVDLRTRAFNVPPCKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPDTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 65643 - protein, 347 aa, Homo sapiens
MLGRSGYRALPLGDFDRFQQSSFGFLGSQKGCLSPERGGVGTGADVPQSWPSCLCHGLISFLGFLLLLVTFPISGWFALKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPDTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 65644 - protein, 356 aa, Homo sapiens
MLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSKLAKDSNTILLPSNPGDVTSMVAQAMGVYGALTKAPVPGTPDSLSSGSSRDVQGTDASLDEELDRVKMS

SEQ ID NO: 65645 - protein, 311 aa, Homo sapiens
MLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRVEAERRKRATVLESEGTRESAINVAEGKKQAQILASEAEKAEQINQAAGEASAVLAKAKAKAEAIRILAAALTQHNGDAAASLTVAEQYVSAFSKLAKDSNTILLPSNPGDVTSMVAQAMGVYGALTKAPVPGTPDSLSSGSSRDVQGTDASLDEELDRVKMS

SEQ ID NO: 65646 - protein, 291 aa, Homo sapiens
MDSRVSSPEKQDKENFVGVNNKRLGVCGWILFSLSFLLVIITFPISIWMCLKIIKEYERAVVFRLGRIQADKAKGPGLILVLPCIDVFVKVDLRTVTCNIPPQEILTRDSVTTQVDGVVYYRIYSAVSAVANVNDVHQATFLLAQTTLRNVLGTQTLSQILAGREEIAHSIQTLLDDATELWGIRVARVEIKDVRIPVQLQRSMAAEAEATREARAKVLAAEGEMNASKSLKSASMVLAESPIALQLRYLQTLSTVATEKNSTIVFPLPMNILEGIGGVSYDNHKKLPNKA

SEQ ID NO: 65647 - protein, 282 aa, Homo sapiens
MNSRGELVGVNNKRLGVCGWILFSLSFLLVIITFPISIWMCLKIIKEYERAVVFRLGRIQADKAKGPGLILVLPCIDVFVKVDLRTVTCNIPPQEILTRDSVTTQVDGVVYYRIYSAVSAVANVNDVHQATFLLAQTTLRNVLGTQTLSQILAGREEIAHSIQTLLDDATELWGIRVARVEIKDVRIPVQLQRSMAAEAEATREARAKVLAAEGEMNASKSLKSASMVLAESPIALQLRYLQTLSTVATEKNSTIVFPLPMNILEGIGGVSYDNHKKLPNKA

SEQ ID NO: 65648 - protein, 989 aa, Homo sapiens
MARPVQLAPGSLALVLCRLEAQKAAGAAEEPGGRAVFRAFRRANARCFWNARLARAASRLAFQGWLRRGVLLVRAPPACLQVLRDAWRRRALRPPRGFRIRAVGDVFPVQMNPITQSQFVPLGEVLCCAISDMNTAQIVVTQESLLERLMKHYPGIAIPSEDILYTTLGTLIKERKIYHTGEGYFIVTPQTYFITNTTTQENKRMLPSDESRLMPASMTYLVSMESCAESAQENAAPISHCQSCQCFRDMHTQDVQEAPVAAEVTRKSHRGLGESVSWVQNGAVSVSAEHHICESTKPLPYTRDKEKGKKFGFSLLWRSLSRKEKPKTEHSSFSAQFPPEEWPVRDEDDLDNIPRDVEHEIIKRINPILTVDNLIKHTVLMQKYEEQKKYNSQGTSTDMLTIGHKYPSKEGVKKRQGLSAKPQGQGHSRRDRHKARNQGSEFQPGSIRLEKHPKLPATQPIPRIKSPNEMVGQKPLGEITTVLGSHLIYKKRISNPFQGLSHRGSTISKGHKIQKTSDLKPSQTGPKEKPFQKPRSLDSSRIFDGKAKEPYAEQPNDKMEAESIYINDPTVKPINDDFRGHLFSHPQQSMLQNDGKCCPFMESMLRYEVYGGENEVIPEVLRKSHSHFDKLGETKQTPHSLPSRGASFSDRTPSACRLVDNTIHQFQNLGLLDYPVGVNPLRQAARQDKDSEELLRKGFVQDAETTSLENEQLSNDDQALYQNEVEDDDGACSSLYLEEDDISENDDLRQMLPGHSQYSFTGGSQGNHLGKQKVIERSLTEYNSTMERVESQVLKRNECYKPTGLHATPGESQEPNLSAESCGLNSGAQFGFNYEEEPSVAKCVQASAPADERIFDYYSARKASFEAEVIQDTIGDTGKKPASWSQSPQNQEMRKHFPQKFQLFNTSHMPVLAQDVQYEHSHLEGTENHSMAGDSGIDSPRTQSLGSNNSVILDGLKRRQNFLQNVEGTKSSQPLTSNSLLPLTPVINV

SEQ ID NO: 65649 - protein, 169 aa, Homo sapiens
MARPVQLAPGSLALVLCRLEAQKAAGAAEEPGGRAVFRAFRRANARCFWNARLARAASRLAFQGWLRRGVLLVRAPPACLQVLRDAWRRRALRPPRGFRIRAVGDVFPVQMNPITQSQFVPLGEVLCCAISDMNTAQIVVTQESLLERLMKHYPGHRVWDLIIQSFWMD

SEQ ID NO: 65650 - protein, 227 aa, Homo sapiens
MARPVQLAPGSLALVLCRLEAQKAAGAAEEPGGRAVFRAFRRANARCFWNARLARAASRLAFQGWLRRGVLLVRAPPACLQVLRDAWRRRALRPPRGFRIRAVGDVFPVQMNPITQSQFVPLGEVLCCAISDMNTAQIVVTQESLLERLMKHYPGIAIPSEDILYTTLGTLIKERKIYHTGEGYFIVTPQTYFITNTTTQENKRMLPSDESRLMPASMTYLDTESGI

SEQ ID NO: 65651 - protein, 989 aa, Homo sapiens; identical to SEQ ID NO: 65648

SEQ ID NO: 65652 - protein, 879 aa, Homo sapiens
MNPITQSQFVPLGEVLCCAISDMNTAQIVVTQESLLERLMKHYPGIAIPSEDILYTTLGTLIKERKIYHTGEGYFIVTPQTYFITNTTTQENKRMLPSDESRLMPASMTYLVSMESCAESAQENAAPISHCQSCQCFRDMHTQDVQEAPVAAEVTRKSHRGLGESVSWVQNGAVSVSAEHHICESTKPLPYTRDKEKGKKFGFSLLWRSLSRKEKPKTEHSSFSAQFPPEEWPVRDEDDLDNIPRDVEHEIIKRINPILTVDNLIKHTVLMQKYEEQKKYNSQGTSTDMLTIGHKYPSKEGVKKRQGLSAKPQGQGHSRRDRHKARNQGSEFQPGSIRLEKHPKLPATQPIPRIKSPNEMVGQKPLGEITTVLGSHLIYKKRISNPFQGLSHRGSTISKGHKIQKTSDLKPSQTGPKEKPFQKPRSLDSSRIFDGKAKEPYAEQPNDKMEAESIYINDPTVKPINDDFRGHLFSHPQQSMLQNDGKCCPFMESMLRYEVYGGENEVIPEVLRKSHSHFDKLGETKQTPHSLPSRGASFSDRTPSACRLVDNTIHQFQNLGLLDYPVGVNPLRQAARQDKDSEELLRKGFVQDAETTSLENEQLSNDDQALYQNEVEDDDGACSSLYLEEDDISENDDLRQMLPGHSQYSFTGGSQGNHLGKQKVIERSLTEYNSTMERVESQVLKRNECYKPTGLHATPGESQEPNLSAESCGLNSGAQFGFNYEEEPSVAKCVQASAPADERIFDYYSARKASFEAEVIQDTIGDTGKKPASWSQSPQNQEMRKHFPQKFQLFNTSHMPVLAQDVQYEHSHLEGTENHSMAGDSGIDSPRTQSLGSNNSVILDGLKRRQNFLQNVEGTKSSQPLTSNSLLPLTPVINV

SEQ ID NO: 65653 - protein, 1392 aa, Homo sapiens
MVEPGQDLLLAALSESGISPNDLFDIDGGDAGLATPMPTPSVQQSVPLSALELGLETEAAVPVKQEPETVPTPALLNVRQPPSTTTFVLNQINHLPPLGSTIVMTKTPPVTTNRQTITLTKFIQTTASTRPSVSAPTVRNAMTSAPSKDQVQLKDLLKNNSLNELMKLKPPANIAQPVATAATDVSNGTVKKESSNKEGARMWINDMKMRSFSPTMKVPVVKEDDEPEEEDEEEMGHAETYAEYMPIKLKIGLRHPDAVVETSSLSSVTPPDVWYKTSISEETIDNGWLSALQLEAITYAAQQHETFLPNGDRAGFLIGDGAGVGKGRTIAGIIYENYLLSRKRALWFSVSNDLKYDAERDLRDIGAKNILVHSLNKFKYGKISSKHNGSVKKGVIFATYSSLIGESQSGGKYKTRLKQLLHWCGDDFDGVIVFDECHKAKNLCPVGSSKPTKTGLAVLELQNKLPKARVVYASATGASEPRNMAYMNRLGIWGEGTPFREFSDFIQAVERRGVGAMEIVAMDMKLRGMYIARQLSFTGVTFKIEEVLLSQSYVKMYNKAVKLWVIARERFQQAADLIDAEQRMKKSMWGQFWSAHQRFFKYLCIASKVKRVVQLAREEIKNGKCVVIGLQSTGEARTLEALEEGGGELNDFVSTAKGVLQSLIEKHFPAPDRKKLYSLLGIDLTAPSNNSSPRDSPCKENKIKKRKGEEITREAKKARKVGGLTGSSSDDSGSESDASDNEESDYESSKNMSSGDDDDFNPFLDESNEDDENDPWLIRKDHKKNKEKKKKKSIDPDSIQSALLASGLGSKRPSFSSTPVISPAPNSTPANSNTNSNSSLITSQDAVERAQQMKKDLLDKLEKLAEDLPPNTLDELIDELGGPENVAEMTGRKGRVVSNDDGSISYESRSELDVPVEILNITEKQRFMDGDKNIAIISEAASSGISLQADRRAKNQRRRVHMTLELPWSADRAIQQFGRTHRSNQVTAPEYVFLISELAGEQRFASIVAKRLESLGALTHGDRRATESRDLSRFNFDNKYGRNALEIVMKSIVNLDSPMVSPPPDYPGEFFKDVRQGLIGVGLINVEDRSGILTLDKDYNNIGKFLNRILGMEVHQQNALFQYFADTLTAVVQNAKKNGRYDMGILDLGSGDEKVRKSDVKKFLTPGYSTSGHVELYTISVERGMSWEEATKIWAELTGPDDGFYLSLQIRNNKKTAILVKEVNPKKKLFLVYRPNTGKQLKLEIYADLKKKYKKVVSDDALMHWLDQYNSSADTCTHAYWRGNCKKASLGLVCEIGLRCRTYYVLCGSVLSVWTKVEGVLASVSGTNVKMQIVRLRTEDGQRIVGLIIPANCVSPLVNLLSTSDQSQQLAVQQKQLWQQHHPQSITNLSNA

SEQ ID NO: 65654 - protein, 1393 aa, Homo sapiens
MVEPGQDLLLAALSESGISPNDLFDIDGGDAGLATPMPTPSVQQSVPLSALELGLETEAAVPVKQEPETVPTPALLNVRQQPPSTTTFVLNQINHLPPLGSTIVMTKTPPVTTNRQTITLTKFIQTTASTRPSVSAPTVRNAMTSAPSKDQVQLKDLLKNNSLNELMKLKPPANIAQPVATAATDVSNGTVKKESSNKEGARMWINDMKMRSFSPTMKVPVVKEDDEPEEEDEEEMGHAETYAEYMPIKLKIGLRHPDAVVETSSLSSVTPPDVWYKTSISEETIDNGWLSALQLEAITYAAQQHETFLPNGDRAGFLIGDGAGVGKGRTIAGIIYENYLLSRKRALWFSVSNDLKYDAERDLRDIGAKNILVHSLNKFKYGKISSKHNGSVKKGVIFATYSSLIGESQSGGKYKTRLKQLLHWCGDDFDGVIVFDECHKAKNLCPVGSSKPTKTGLAVLELQNKLPKARVVYASATGASEPRNMAYMNRLGIWGEGTPFREFSDFIQAVERRGVGAMEIVAMDMKLRGMYIARQLSFTGVTFKIEEVLLSQSYVKMYNKAVKLWVIARERFQQAADLIDAEQRMKKSMWGQFWSAHQRFFKYLCIASKVKRVVQLAREEIKNGKCVVIGLQSTGEARTLEALEEGGGELNDFVSTAKGVLQSLIEKHFPAPDRKKLYSLLGIDLTAPSNNSSPRDSPCKENKIKKRKGEEITREAKKARKVGGLTGSSSDDSGSESDASDNEESDYESSKNMSSGDDDDFNPFLDESNEDDENDPWLIRKDHKKNKEKKKKKSIDPDSIQSALLASGLGSKRPSFSSTPVISPAPNSTPANSNTNSNSSLITSQDAVERAQQMKKDLLDKLEKLAEDLPPNTLDELIDELGGPENVAEMTGRKGRVVSNDDGSISYESRSELDVPVEILNITEKQRFMDGDKNIAIISEAASSGISLQADRRAKNQRRRVHMTLELPWSADRAIQQFGRTHRSNQVTAPEYVFLISELAGEQRFASIVAKRLESLGALTHGDRRATESRDLSRFNFDNKYGRNALEIVMKSIVNLDSPMVSPPPDYPGEFFKDVRQGLIGVGLINVEDRSGILTLDKDYNNIGKFLNRILGMEVHQQNALFQYFADTLTAVVQNAKKNGRYDMGILDLGSGDEKVRKSDVKKFLTPGYSTSGHVELYTISVERGMSWEEATKIWAELTGPDDGFYLSLQIRNNKKTAILVKEVNPKKKLFLVYRPNTGKQLKLEIYADLKKKYKKVVSDDALMHWLDQYNSSADTCTHAYWRGNCKKASLGLVCEIGLRCRTYYVLCGSVLSVWTKVEGVLASVSGTNVKMQIVRLRTEDGQRIVGLIIPANCVSPLVNLLSTSDQSQQLAVQQKQLWQQHHPQSITNLSNA

SEQ ID NO: 65655 - protein, 732 aa, Homo sapiens
MVEPGQDLLLAALSESGISPNDLFDIDGGDAGLATPMPTPSVQQSVPLSALELGLETEAAVPVKQEPETVPTPALLNVRQPPSTTTFVLNQINHLPPLGSTIVMTKTPPVTTNRQTITLTKFIQTTASTRPSVSAPTVRNAMTSAPSKDQVQLKDLLKNNSLNELMKLKPPANIAQPVATAATDVSNGTVKKESSNKEGARMWINDMKMRSFSPTMKVPVVKEDDEPEEEDEEEMGHAETYAEYMPIKLKIGLRHPDAVVETSSLSSVTPPDVWYKTSISEETIDNGWLSALQLEAITYAAQQHETFLPNGDRAGFLIGDGAGVGKGRTIAGIIYENYLLSRKRALWFSVSNDLKYDAERDLRDIGAKNILVHSLNKFKYGKISSKHNGSVKKGVIFATYSSLIGESQSGGKYKTRLKQLLHWCGDDFDGVIVFDECHKAKNLCPVGSSKPTKTGLAVLELQNKLPKARVVYASATGASEPRNMAYMNRLGIWGEGTPFREFSDFIQAVERRGVGAMEIVAMDMKLRGMYIARQLSFTGVTFKIEEVLLSQSYVKMYNKAVKLWVIARERFQQAADLIDAEQRMKKSMWGQFWSAHQRFFKYLCIASKVKRVVQLAREEIKNGKCVVIGLQSTGEARTLEALEEGGGELNDFVSTAKGVLQSLIEKHFPAPDRKKLYSLLGIDLTAPSNNSSPRDSPCKENKIKKRKGEEITREAKKARKMSLMRMMKMVSS

SEQ ID NO: 65656 - protein, 543 aa, Homo sapiens
MEQVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPTNMTYITNQAAVYFEKGDYNKCRELCEKAIEVGRENREDYRQIAKAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 65657 - protein, 1268 aa, Homo sapiens
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNTQVTWMLAQRQQEEARQQQERAAMSYVKLRTNLQHAIRRGTSLMEDDEEPIVEDVMMSSEGRIEDLNEGMDFDTMDIDLPPSKNRRERTELKPDFFDPASIMDESVLGVSMF

SEQ ID NO: 65658 - protein, 1162 aa, Homo sapiens
MNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNRRGTSLMEDDEEPIVEDVMMSSEGRIEDLNEGMDFDTMDIDLPPSKNRRERTELKPDFFDPASIMDESVLGVSMF

SEQ ID NO: 65659 - protein, 1231 aa, Homo sapiens
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNRRGTSLMEDDEEPIVEDVMMSSEGRIEDLNEGMDFDTMDIDLPPSKNRRERTELKPDFFDPASIMDESVLGVSMF

SEQ ID NO: 65660 - protein, 1268 aa, Homo sapiens; identical to SEQ ID NO: 65657

SEQ ID NO: 65661 - protein, 1231 aa, Homo sapiens; identical to SEQ ID NO: 65659

SEQ ID NO: 65662 - protein, 1231 aa, Homo sapiens; identical to SEQ ID NO: 65659

SEQ ID NO: 65663 - protein, 70 aa, Homo sapiens
MIAAPEIPTDFNLLQESETHFSSDTDFEDIEGKNQKQGKGKTCKKGKKGPAEKGKGGNGGGKPPSGPNRM

SEQ ID NO: 65664 - protein, 115 aa, Homo sapiens
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALL

SEQ ID NO: 65665 - protein, 169 aa, Homo sapiens
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWK

SEQ ID NO: 65666 - protein, 154 aa, Homo sapiens
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDE

SEQ ID NO: 65667 - protein, 208 aa, Homo sapiens
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLS

SEQ ID NO: 65668 - protein, 548 aa, Homo sapiens
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVL

SEQ ID NO: 65669 - protein, 40 aa, Homo sapiens
MIAAPEIPTDFNLLQESETHFSSDTDFEDIEGKNQKQGKG

SEQ ID NO: 65670 - protein, 1225 aa, Homo sapiens
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQSLVDEWLDSYKQDQDAGFLELVNFFIQSCGCKGIVTPEMFKKMSNSEIIQHLTEQFNEDSGDYPLIAPGPSWKKFQGSFCEFVRTLVCQCQYSLLYDGFPMDDLISLLTGLSDSQVRAFRHTSTLAAMKLMTSLVKVALQLSVHQDNNQRQYEAERNKGPGQRAPERLESLLEKRKELQEHQEEIEGMMNALFRGVFVHRYRDVLPEIRAICIEEIGCWMQSYSTSFLTDSYLKYIGWTLHDKHREVRLKCVKALKGLYGNRDLTTRLELFTSRFKDRMVSMVMDREYDVAVEAVRLLILILKNMEGVLTDADCESVYPVVYASHRGLASAAGEFLYWKLFYPECEIRMMGGREQRQSPGAQRTFFQLLLSFFVESELHDHAAYLVDSLWDCAGARLKDWEGLTSLLLEKDQNLGDVQESTLIEILVSSARQASEGHPPVGRVTGRKGLTSKERKTQADDRVKLTEHLIPLLPQLLAKFSADAEKVTPLLQLLSCFDLHIYCTGRLEKHLELFLQQLQEVVVKHAEPAVLEAGAHALYLLCNPEFTFFSRADFARSQLVDLLTDRFQQELEELLQSSFLDEDEVYNLAATLKRLSAFYNTHDLTRWELYEPCCQLLQKAVDTGEVPHQVILPALTLVYFSILWTLTHISKSDASQKQLSSLRDRMVAFCELCQSCLSDVDTEIQEQAFVLLSDLLLIFSPQMIVGGRDFLRPLVFFPEATLQSELASFLMDHVFIQPGDLGSGDSQEDHLQIERLHQRRRLLAGFCKLLLYGVLEMDAASDVFKHYNKFYNDYGDIIKETLTRARQIDRSHCSRILLLSLKQLYTELLQEHGPQGLNELPAFIEMRDLARRFALSFGPQQLQNRDLVVMLHKEGIQFSLSELPPAGSSNQPPNLAFLELLSEFSPRLFHQDKQLLLSYLEKCLQHVSQAPGHPWGPVTTYCHSLSPVENTAETSPQVLPSSKRRRVEGPAKPNREDVSSSQEESLQLNSIPPTPTLTSTAVKSRQPLWGLKEMEEEDGSELDFAQGQPVAGTERSRFLGPQYFQTPHNPSGPGLGNQLMRLSLMEEDEEEELEIQDESNEERQDTDMQASSYSSTSERGLDLLDSTELDIEDF

SEQ ID NO: 65671 - protein, 888 aa, Homo sapiens
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQSLVDEWLDSYKQDQDAGFLELVNFFIQSCGCKGIVTPEMFKKMSNSEIIQHLTEQFNEMDDLISLLTGLSDSQVRAFRHTSTLAAMKLMTSLVKVALQLSVHQDNNQRQYEAERNKGPGQRAPERLESLLEKRKELQEHQEEIEGMMNALFRGVFVHRYRDVLPEIRAICIEEIGCWMQSYSTSFLTDSYLKYIGWTLHDKHREVRLKCVKALKGLYGNRDLTTRLELFTSRFKDRMVSMVMDREYDVAVEAVRLLILILKNMEGVLTDADCESVYPVVYASHRGLASAAGEFLYWKLFYPECEIRMMGGREQRQSPGAQRTFFQLLLSFFVESELHDHAAYLVDSLWDCAGARLKDWEGLTSLLLEKDQNLGDVQESTLIEILVSSARQASEGHPPVGRVTGRKGLTSKERKTQADDRVKLTEHLIPLLPQLLAKFSADAEKVTPLLQLLSCFDLHIYCTGRLEKHLELFLQQLQEVVVKHAEPAVLEAGAHALYLLCNPEFTFFSRADFARSQLVDLLTDRFQQELEELLQSSFLDEDEVYNLAATLKRLSAFYNTHDLTRWELYEPCCQLLQKAVDTGEVPHQVILPALTLVYFSILWTLTHSLSPVENTAETSPQVLPSSKRRRVEGPAKPNREDVSSSQEESLQLNSIPPTPTLTSTAVKSRQPLWGLKEMEEEDGSELDFAQGQPVAGTERSRFLGPQYFQTPHNPSGPGLGNQLMRLSLMEEDEEEELEIQDESNEERQDTDMQASSYSSTSERGLDLLDSTELDIEDF

SEQ ID NO: 65672 - protein, 262 aa, Homo sapiens
MLHKEGIQFSLSELPPAGSSNQPPNLAFLELLSEFSPRLFHQDKQLLLSYLEKCLQHVSQAPGHPWGPVTTYCHSLSPVENTAETSPQVLPSSKRRRVEGPAKPNREDVSSSQEESLQLNSIPPTPTLTSTAVKSRQPLWGLKEMEEEDGSELDFAQGSQPVAGTERSRFLGPQYFQTPHNPSGPGLGNQLMRLSLMEEDEEEELEIQDESNEERQDTDMQASSYSSTSERGLDLLDSTELDIEITESLPLLGKSPHPYNSR

SEQ ID NO: 65673 - protein, 145 aa, Homo sapiens
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQSLVDEWLDSYKQDQDAGFLELVNFFIQSCGCKG

SEQ ID NO: 65674 - protein, 112 aa, Homo sapiens
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQ

SEQ ID NO: 65675 - protein, 1225 aa, Homo sapiens; identical to SEQ ID NO: 65670

SEQ ID NO: 65676 - protein, 188 aa, Homo sapiens
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQDSGDYPLIAPGPSWKKFQGSFCEFVRTLVCQCQYSLLYDGFPMDDLISLLTGLSDSQVRAFRHTSTLAAMKLMTSL

SEQ ID NO: 65677 - protein, 348 aa, Homo sapiens
MVWPWVAMASRWGPLIGLAPCCLWLLGAVLLMDASARPANHSSTRERVANREENEILPPDHLNGVKLEMDGHLNRGFHQEVFLGKDLGGFDEDAEPRRSRRKLMVIFSKVDVNTDRKISAKEMQRWIMEKTAEHFQEAMEESKTHFRAVDPDGDGHVSWDEYKVKFLASKGHSEKEVADAIRLNEELKVDEETQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELENVPTLPLQPIGTLNSHFVRLAAELGGGKATLTCAPLARRATWTP

SEQ ID NO: 65678 - protein, 362 aa, Homo sapiens
MVWPWVAMASRWGPLIGLAPCCLWLLGAVLLMDASARPANHSSTRERVANREENEILPPDHLNGVKLEMDGHLNRGFHQEVFLGKDLGGFDEDAEPRRSRRKLMVIFSKVDVNTDRKISAKEMQRWIMEKTAEHFQEAMEESKTHFRAVDPDGDGHVSWDEYKVKFLASKGHSEKEVADAIRLNEELKVDEETQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELESYMDPMNEYNALNEAKQMIAVADENQNHHLEPEEVLKYSEFFTGSKLVDYARSVHEEF

SEQ ID NO: 65679 - protein, 243 aa, Homo sapiens
  MOD_RES (1)..(1): Any amino acid
XLEMDGHLNRGFHQEVFLGKDLGGFDEDAEPRRSRRKLMVIFSKVDVNTDRKISAKEMQRWIMEKTAEHFQEAMEESKTHFRAVDPDGDGHVSWDEYKVKFLASKGHSEKEVADAIRLNEELKVDEESSTSRNFLDLRAGVCRPRYPQAAPLSAQEVLENLKDRWYQADSPPADLLLTEEEFLSFLHPEHSRGMLRFMVKEIVRDLDQDGDKQLSVPEFISLPVGTVENQQGQDIDDNWVKDR

SEQ ID NO: 65680 - protein, 202 aa, Homo sapiens
MVWPWVAMASRWGPLIGLAPCCLWLLGAVLLMDASARPANHSSTRERVANREENEILPPDHLNGVKLEMDGHLNRGFHQEVFLGKDLGGFDEDAEPRRSRRKLMVIFSKVDVNTDRKISAKEMQRWIMEKTAEHFQEAMEESKTHFRAVDPDGDGHVSWDEYKVKFLASKGHSEKEVADAIRLNEELKVDEERHGPPGPRAL

SEQ ID NO: 65681 - protein, 211 aa, Homo sapiens
MAVVPLLLLGGLWSAVGASSLGVVTCGSVVKLLNTRHNVRLHSHDVRYGSGSGQQSVTGVTSVDDSNSYWRIRGKSATVCERGTPIKCGQPIRLTHVNTGRNLHSHHFTSPLSGNQEVSAFGEEGEGDYLDDWTVLCNGPYWVRDGEVRFKHSSTEVLLSVTGEQYGRPISGQKEVHGMAQPSQNNYWKAMEGIFMKPSELLKAEAHHAEL

SEQ ID NO: 65682 - protein, 221 aa, Homo sapiens
MWSAGRGGAAWPVLLGLLLALLVPGGGAAKTGAELVTCGSVLKLLNTHHRVRLHSHDIKYGSGSGQQSVTGVEASDDANSYWRIRGGSEGGCPRGSPVRCGQAVRLTHVLTGKNLHTHHFPSPLSNNQEVSAFGEDGEGDDLDLWTVRCSGQHWEREAAVRFQHVGTSVFLSVTGEQYGSPIRGQHEVHGMPSANTHNTWKAMEGIFIKPSVEPSAGHDEL

SEQ ID NO: 65683 - protein, 685 aa, Homo sapiens
MDVCVRLALWLLWGLLLHQGQSLSHSHSEKATGTSSGANSEESTAAEFCRIDKPLCHSEDEKLSFEAVRNIHKLMDDDANGDVDVEESDEFLREDLNYHDPTVKHSTFHGEDKLISVEDLWKAWKSSEVYNWTVDEVVQWLITYVELPQYEETFRKLQLSGHAMPRLAVTNTTMTGTVLKMTDRSHRQKLQLKALDTVLFGPPLLTRHNHLKDFMLVVSIVIGVGGCWFAYIQNRYSKEHMKKMMKDLEGLHRAEQSLHDLQERLHKAQEEHRTVEVEKVHLEKKLRDEINLAKQEAQRLKELREGTENERSRQKYAEEELEQVREALRKAEKELESHSSWYAPEALQKWLQLTHEVEVQYYNIKKQNAEKQLLVAKEGAEKIKKKRNTLFGTFHVAHSSSLDDVDHKILTAKQALSEVTAALRERLHRWQQIEILCGFQIVNNPGIHSLVAALNIDPSWMGSTRPNPAHFIMTDDVDDMDEEIVSPLSMQSPSLQSSVRQRLTEPQHGLGSQRDLTHSDSESSLHMSDRQRVAPKPPQMSRAADEALNAMTSNGSHRLIEGVHPGSLVEKLPDSPALAKKALLALNHGLDKAHSLMELSPSAPPGGSPHLDSSRSHSPSSPDPDTPSPVGDSRALQASRNTRIPHLAGKKAVAEEDNGSIGEETDSSPGRKKFPLKIFKKPLKK

SEQ ID NO: 65684 - protein, 833 aa, Homo sapiens
MNAAGIRAPEAAGADGTRLAPGGSPCLRRRGRPEESPAAVVAPRGAGELQAAGAPLRFHPASPRRLHPASTPGPAWGWLLRRRRWAALLVLGLLVAGAADGCELVPRHLRGRRATGSAATAASSPAAAAGDSPALMTDPCMSLSPPCFTEEDRFSLEALQTIHKQMDDDKDGGIEVEESDEFIREDMKYKDATNKHSHLHREDKHITIEDLWKRWKTSEVHNWTLEDTLQWLIEFVELPQYEKNFRDNNVKGTTLPRIAVHEPSFMISQLKISDRSHRQKLQLKALDVVLFGPLTRPPHNWMKDFILTVSIVIGVGGCWFAYTQNKTSKEHVAKMMKDLESLQTAEQSLMDLQERLEKAQEENRNVAVEKQNLERKMMDEINYAKEEACRLRELREGAECELSRRQYAEQELEQVRMALKKAEKEFELRSSWSVPDALQKWLQLTHEVEVQYYNIKRQNAEMQLAIAKDEAEKIKKKRSTVFGTLHVAHSSSLDEVDHKILEAKKALSELTTCLRERLFRWQQIEKICGFQIAHNSGLPSLTSSLYSDHSWVVMPRVSIPPYPIAGGVDDLDEDTPPIVSQFPGTMAKPPGSLARSSSLCRSRRSIVPSSPQPQRAQLAPHAPHPSHPRHPHHPQHTPHSLPSPDPDILSVSSCPALYRNEEEEEAIYFSAEKQWEVPDTASECDSLNSSIGRKQSPPLSLEIYQTLSPRKISRDEVSLEDSSRGDSPVTVDVSWGSPDCVGLTETKSMIFSPASKVYNGILEKSCSMNQLSSGIPVPKPRHTSCSSAGNDSKPVQEAPSVARISSIPHDLCHNGEKSKKPSKIKSLFKKKSK

SEQ ID NO: 65685 - protein, 841 aa, Homo sapiens [sequence omitted]

SEQ ID NO: 65686 - protein, 686 aa, Homo sapiens
MNAAGIRAPEAAGADGTRLAPGGSPCLRRRGRPEESPAAVVAPRGAGELQAAGAPLRFHPASPRRLHPASTPGPAWGWLLRRRRWAALLVLGLLVAGAADGCELVPRHLRGRRATGSAATAASSPAAAAGDSPALMTDPCMSLSPPCFTEEDRFSLEALQTIHKQMDDDKDGGIEVEESDEFIREDMKYKDATNKHSHLHREDKHITIEDLWKRWKTSEVHNWTLEDTLQWLIEFVELPQYEKNFRDNNVKGTTLPRIAVHEPSFMISQLKISDRSHRQKLQLKALDVVLFGPLTRPPHNWMKDFILTVSIVIGVGGCWFAYTQNKTSKEHVAKMMKDLESLQTAEQSLMDLQERLEKAQEENRNVAVEKQNLERKMMDEINYAKEEACRLRELREGAECELSRRQYAEQELEQVRMALKKAEKEFELRSSWSVPDALQKWLQLTHEVEVQYYNIKRQNAEMQLAIAKDEAEKIKKKRSTVFGTLHVAHSSSLDEVDHKILEAKKALSELTTCLRERLFRWQQIEKICGFQIAHNSGLPSLTSSLYSDHSWVVMPRVSIPPYPIAGGVDDLDEDTPPIVSQFPGTMAKPPGSLARSSSLCRSRRSIVPSSPQPQRAQLAPHAPHPSHPRHPHHPQHTPHSLPSPDPDILSVSSCPALYRNEEEEEAIYFSAEKQCIHLGLGACKSE

SEQ ID NO: 65687 - protein, 746 aa, Homo sapiens
LLVLGLLVAGAADGCELVPRHLRGRRATGSAATAASSPAAAAGDSPALMTDPCMSLSPPCFTEEDRFSLEALQTIHKQMDDDKDGGIEVEESDEFIREDMKYKDATNKHSHLHREDKHITIEDLWKRWKTSEVHNWTLEDTLQWLIEFVELPQYEKNFRDNNVKGTTLPRIAVHEPSFMISQLKISDRSHRQKLQLKALDVVLFGPLTRPPHNWMKDFILTVSIVIGVGGCWFAYTQNKTSKEHVAKMMKDLESLQTAEQSLMDLQERLEKAQEENRNVAVEKQNLERKMMDEINYAKEEACRLRELREGAECELSRRQYAEQELEQVRMALKKAEKEFELRSSWSVPDALQKWLQLTHEVEVQYYNIKRQNAEMQLAIAKDEAEKIKKKRSTVFGTLHVAHSSSLDEVDHKILEAKKALSELTTCLRERLFRWQQIEKICGFQIAHNSGLPSLTSSLYSDHSWVVMPRVSIPPYPIAGGVDDLDEDTPPIVSQFPGTMAKPPGSLARSSSLCRSRRSIVPSSPQPQRAQLAPHAPHPSHPRHPHHPQHTPHSLPSPDPDILSVSSCPALYRNEEEEEAIYFSAEKQWEVPDTASECDSLNSSIGRKQSPPLSLEIYQTLSPRKISRDEVSLEDSSRGDSPVTVDVSWGSPDCVGLTETKSMIFSPASKVYNGILEKSCSMNQLSSGIPVPKPRHTSCSSAGNDSKPVQEAPSVARISSIPHDLCHNGEKSKKPSKIKSLFKKKSK

SEQ ID NO: 65688 - protein, 754 aa, Homo sapiens
LLVLGLLVAGAADGCELVPRHLRGRRATGSAATAASSPAAAAGDSPALMTDPCMSLSPPCFTEEDRFSLEALQTIHKQMDDDKDGGIEVEESDEFIREDMKYKDATNKHSHLHREDKHITIEDLWKRWKTSEVHNWTLEDTLQWLIEFVELPQYEKNFRDNNVKGTTLPRIAVHEPSFMISQLKISDRSHRQKLQLKALDVVLFGPLTRPPHNWMKDFILTVSIVIGVGGCWFAYTQNKTSKEHVAKMMKDLESLQTAEQSLMDLQERLEKAQEENRNVAVEKQNLERKMMDEINYAKEEACRLRELREGAECELSRRQYAEQELEQVRMALKKAEKEFELRSSWSVPDALQKWLQLTHEVEVQYYNIKRQNAEMQLAIAKDEVAASYLIQAEKIKKKRSTVFGTLHVAHSSSLDEVDHKILEAKKALSELTTCLRERLFRWQQIEKICGFQIAHNSGLPSLTSSLYSDHSWVVMPRVSIPPYPIAGGVDDLDEDTPPIVSQFPGTMAKPPGSLARSSSLCRSRRSIVPSSPQPQRAQLAPHAPHPSHPRHPHHPQHTPHSLPSPDPDILSVSSCPALYRNEEEEEAIYFSAEKQWEVPDTASECDSLNSSIGRKQSPPLSLEIYQTLSPRKISRDEVSLEDSSRGDSPVTVDVSWGSPDCVGLTETKSMIFSPASKVYNGILEKSCSMNQLSSGIPVPKPRHTSCSSAGNDSKPVQEAPSVARISSIPHDLCHNGEKSKKPSKIKSLFKKKSK

SEQ ID NO: 65689 - protein, 599 aa, Homo sapiens
LLVLGLLVAGAADGCELVPRHLRGRRATGSAATAASSPAAAAGDSPALMTDPCMSLSPPCFTEEDRFSLEALQTIHKQMDDDKDGGIEVEESDEFIREDMKYKDATNKHSHLHREDKHITIEDLWKRWKTSEVHNWTLEDTLQWLIEFVELPQYEKNFRDNNVKGTTLPRIAVHEPSFMISQLKISDRSHRQKLQLKALDVVLFGPLTRPPHNWMKDFILTVSIVIGVGGCWFAYTQNKTSKEHVAKMMKDLESLQTAEQSLMDLQERLEKAQEENRNVAVEKQNLERKMMDEINYAKEEACRLRELREGAECELSRRQYAEQELEQVRMALKKAEKEFELRSSWSVPDALQKWLQLTHEVEVQYYNIKRQNAEMQLAIAKDEAEKIKKKRSTVFGTLHVAHSSSLDEVDHKILEAKKALSELTTCLRERLFRWQQIEKICGFQIAHNSGLPSLTSSLYSDHSWVVMPRVSIPPYPIAGGVDDLDEDTPPIVSQFPGTMAKPPGSLARSSSLCRSRRSIVPSSPQPQRAQLAPHAPHPSHPRHPHHPQHTPHSLPSPDPDILSVSSCPALYRNEEEEEAIYFSAEKQCIHLGLGACKSE

SEQ ID NO: 65690 - protein, 1217 aa, Homo sapiens
MYIKQVIIQGFRSYRDQTIVDPFSSKHNVIVGRNGSGKSNFFYAIQFVLSDEFSHLRPEQRLALLHEGTGPRVISAFVEIIFDNSDNRLPIDKEEVSLRRVIGAKKDQYFLDKKMVTKNDVMNLLESAGFSRSNPYYIVKQGKINQMATAPDSQRLKLLREVAGTRVYDERKEESISLMKETEGKREKINELLKYIEERLHTLEEEKEELAQYQKWDKMRRALEYTIYNQELNETRAKLDELSAKRETSGEKSRQLRDAQQDARDKMEDIERQVRELKTKISAMKEEKEQLSAERQEQIKQRTKLELKAKDLQDELAGNSEQRKRLLKERQKLLEKIEEKQKELAETEPKFNSVKEKEERGIARLAQATQERTDLYAKQGRGSQFTSKEERDKWIKKELKSLDQAINDKKRQIAAIHKDLEDTEANKEKNLEQYNKLDQDLNEVKARVEELDRKYYEVKNKKDELQSERNYLWREENAEQQALAAKREDLEKKQQLLRAATGKAILNGIDSINKVLDHFRRKGINQHVQNGYHGIVMNNFECEPAFYTCVEVTAGNRLFYHIVDSDEVSTKILMEFNKMNLPGEVTFLPLNKLDVRDTAYPETNDAIPMISKLRYNPRFDKAFKHVFGKTLICRSMEVSTQLARAFTMDCITLEGDQVSHRGALTGGYYDTRKSRLELQKDVRKAEEELGELEAKLNENLRRNIERINNEIDQLMNQMQQIETQQRKFKASRDSILSEMKMLKEKRQQSEKTFMPKQRSLQSLEASLHAMESTRESLKAELGTDLLSQLSLEDQKRVDALNDEIRQLQQENRQLLNERIKLEGIITRVETYLNENLRKRLDQVEQELNELRETEGGTVLTATTSELEAINKRVKDTMARSEDLDNSIDKTEAGIKELQKSMERWKNMEKEHMDAINHDTKELEKMTNRQGMLLKKKEECMKKIRELGSLPQEAFEKYQTLSLKQLFRKLEQCNTELKKYSHVNKKALDQFVNFSEQKEKLIKRQEELDRGYKSIMELMNVLELRKYEAIQLTFKQVSKNFSEVFQKLVPGGKATLVMKKGDVEGSQSQDEGEGSGESERGSGSQSSVPSVDQFTGVGIRVSFTGKQGEMREMQQLSGGQKSLVALALIFAIQKCDPAPFYLFDEIDQALDAQHRKAVSDMIMELAVHAQFITTTFRPELLESADKFYGVKFRNKVSHIDVITAEMAKDFVEDDTTHG

SEQ ID NO: 65691 - protein, 1101 aa, Homo sapiens
MATPSKKTSTPSPQPSKRALPRDPSSEVPSKRKNSAPQLPLLQSSGPFVEGSIVRISMENFLTYDICEVSPGPHLNMIVGANGTGKSSIVCAICLGLAGKPAFMGRADKVGFFVKRGCSRGMVEIELFRASGNLVITREIDVAKNQSFWFINKKSTTQKIVEEKVAALNIQVGNLCQFLPQDKVGEFAKLSKIELLEATEKSIGPPEMHKYHCELKNLREKEKQLETSCKEKTEYLQKMVQRNERYKQDVERFYERKRHLDLIEMLEAKRPWVEYENVRQEYEEVKLVRDRVKEEVRKLKEGQIPVTCRIEEMENERHNLEARIKEKATDIKEASQKCKQKQDVIERKDKHIEELQQALIVKQNEELDRQRRIGNTRKMIEDLQNELKTTENCENLQPQIDAITNDLRRIQDEKALCEGEIIDKRRERETLEKEKKSVDDHIVRFDNLMNQKEDKLRQRFRDTYDAVLWLRNNRDKFKQRVCEPIMLTINMKDNKNAKYIENHIPSNDLRAFVFESQEDMEVFLKEVRDNKKLRVNAVIAPKSSYADKAPSRSLNELKQYGFFSYLRELFDAPDPVMSYLCCQYHIHEVPVGTEKTRERIERVIQETRLKQIYTAEEKYVVKTSFYSNKVISSNTSLKVAQFLTVTVDLEQRRHLEEQLKEIHRKLQAVDSGLIALRETSKHLEHKDNELRQKKKELLERKTKKRQLEQKISSKLGSLKLMEQDTCNLEEEERKASTKIKEINVQKAKLVTELTNLIKICTSLHIQKVDLILQNTTVISEKNKLESDYMAASSQLRLTEQHFIELDENRQRLLQKCKELMKRARQVCNLGAEQTLPQEYQTQVPTIPNGHNSSLPMVFQDLPNTLDEIDALLTEERSRASCFTGLNPTIVQEYTKREEEIEQLTEELKGKKVELDQYRENISQVKERWLNPLKELVEKINEKFSNFFSSMQCAGEVDLHTENEEDYDKYGIRIRVKFRSSTQLHELTPHHQSGGERSVSTMLYLMALQELNRCPFRVVDEINQGMDPINERRVFEMVVNTACKENTSQYFFITPKLLQNLPYSEKMTVLFVYNGPHMLEPNTWNLKAFQRRRRRITFTQPS

SEQ ID NO: 65692 - protein, 1091 aa, Homo sapiens
MAKRKEENFSSPKNAKRPRQEELEDFDKDGDEDECKGTTLTAAEVGIIESIHLKNFMCHSMLGPFKFGSNVNFVVGNNGSGKSAVLTALIVGLGGRAVATNRGSSLKGFVKDGQNSADISITLRNRGDDAFKASVYGNSILIQQHISIDGSRSYKLKSATGSVVSTRKEELIAILDHFNIQVDNPVSVLTQEMSKQFLQSKNEGDKYKFFMKATQLEQMKEDYSYIMETKERTKEQIHQGEERLTELKRQCVEKEERFQSIAGLSTMKTNLESLKHEMAWAVVNEIEKQLNAIRDNIKIGEDRAARLDRKMEEQQVRLNEAEQKYKDIQDKLEKISEETNARAPECMALKADVVAKKRAYNEAEVLYNRSLNEYKALKKDDEQLCKRIEELKKSTDQSLEPERLERQKKISWLKERVKAFQNQENSVNQEIEQFQQAIEKDKEEHGKIKREELDVKHALSYNQRQLKELKDSKTDRLKRFGPNVPALLEAIDDAYRQGHFTYKPVGPLGACIHLRDPELALAIESCLKGLLQAYCCHNHADERVLQALMKRFYLPGTSRPPIIVSEFRNEIYDVRHRAAYHPDFPTVLTALEIDNAVVANSLIDMRGIETVLLIKNNSVARAVMQSQKPPKNCREAFTADGDQVFAGRYYSSENTRPKFLSRDVDSEISDLENEVENKTAQILNLQQHLSALEKDIKHNEELLKRCQLHYKELKMKIRKNISEIRELENIEEHQSVDIATLEDEAQENKSKMKMVEEHMEQQKENMEHLKSLKIEAENKYDAIKFKINQLSELADPLKDELNLADSEVDNQKRGKRHYEEKQKEHLDTLNKKKRELDMKEKELEEKMSQARQICPERIEVEKSASILDKEINRLRQKIQAEHASHGDREEIMRQYQEARETYLDLDSKVRTLKKFIKLLGEIMEHRFKTYQQFRRCLTLRCKLYFDNLLSQRAYCGKMNFDHKNETLSISVQPGEGNKAAFNDMRALSGGERSFSTVCFILSLWSIAESPFRCLDEFDVYMDMVNRRIAMDLILKMADSQRFRQFILLTPQSMSSLPSSKLIRILRMSDPERGQTTLPFRPVTQEEDDDQR

SEQ ID NO: 65693 - protein, 1117 aa, Homo sapiens
MAKRKEENFSSPKNAKRPRQEELEDFDKDGDEDECKGTTLTAAEVGIIESIHLKNFMCHSMLGPFKFGSNVNFVVGNNGSWSAVVRSRLNATSASQVQAILLFQPCGKSAVLTALIVGLGGRAVATNRGSSLKGFVKDGQNSADISITLRNRGDDAFKASVYGNSILIQQHISIDGSRSYKLKSATGSVVSTRKEELIAILDHFNIQVDNPVSVLTQEMSKQFLQSKNEGDKYKFFMKATQLEQMKEDYSYIMETKERTKEQIHQGEERLTELKRQCVEKEERFQSIAGLSTMKTNLESLKHEMAWAVVNEIEKQLNAIRDNIKIGEDRAARLDRKMEEQQVRLNEAEQKYKDIQDKLEKISEETNARAPECMALKADVVAKKRAYNEAEVLYNRSLNEYKALKKDDEQLCKRIEELKKSTDQSLEPERLERQKKISWLKERVKAFQNQENSVNQEIEQFQQAIEKDKEEHGKIKREELDVKHALSYNQRQLKELKDSKTDRLKRFGPNVPALLEAIDDAYRQGHFTYKPVGPLGACIHLRDPELALAIESCLKGLLQAYCCHNHADERVLQALMKRFYLPGTSRPPIIVSEFRNEIYDVRHRAAYHPDFPTVLTALEIDNAVVANSLIDMRGIETVLLIKNNSVARAVMQSQKPPKNCREAFTADGDQVFAGRYYSSENTRPKFLSRDVDSEISDLENEVENKTAQILNLQQHLSALEKDIKHNEELLKRCQLHYKELKMKIRKNISEIRELENIEEHQSVDIATLEDEAQENKSKMKMVEEHMEQQKENMEHLKSLKIEAENKYDAIKFKINQLSELADPLKDELNLADSEVDNQKRGKRHYEEKQKEHLDTLNKKKRELDMKEKELEEKMSQARQICPERIEVEKSASILDKEINRLRQKIQAEHASHGDREEIMRQYQEARETYLDLDSKVRTLKKFIKLLGEIMEHRFKTYQQFRRCLTLRCKLYFDNLLSQRAYCGKMNFDHKNETLSISVQPGEGNKAAFNDMRALSGGERSFSTVCFILSLWSIAESPFRCLDEFDVYMDMVNRRIAMDLILKMADSQRFRQFILLTPQSMSSLPSSKLIRILRMSDPERGQTTLPFRPVTQEEDDDQR

SEQ ID NO: 65694 - protein, 1091 aa, Homo sapiens; identical to SEQ ID NO: 65692

SEQ ID NO: 65695 - protein, 57 aa, Homo sapiens
MAKRKEENFSSPKNAKRPRQEELEDFDKDGDEDECKGTTLTAAEVGIIESIHLKNFM

SEQ ID NO: 65696 - protein, 1091 aa, Homo sapiens; identical to SEQ ID NO: 65692

SEQ ID NO: 65697 - protein, 709 aa, Homo sapiens
MAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRSFDFEIETKQGTQYTFSSIEREEYGKLFDFVNAKKLNIKNRGLKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 65698 - protein, 79 aa, Homo sapiens
MKSLTWILGLWALAACFTPGESQRGPRGPYPPGPLAPPQPFGPGFVPPPPPPPYGPGRIPPPPPAPYGPGIFPPPPPQP

SEQ ID NO: 65699 - protein, 107 aa, Homo sapiens
MKSLTWILGLWALAACFTPGESQRGPRGPYPPGPLAPPQPFGPGFVPPPPPPPYGPGRIPPPPYSCTPNMNNCSRCHHHHKRHHYPCNYCFYYPKYEFQHCFQETFT

SEQ ID NO: 65700 - protein, 79 aa, Homo sapiens; identical to SEQ ID NO: 65698

SEQ ID NO: 65701 - protein, 115 aa, Homo sapiens
MSRHSRLQRQVLSLYRDLLRAGRGKPGAEARVRAEFRQHAGLPRSDVLRIEYLYRRGRRQLQLLRSGHATAMGAFVRPRAPTGEPGGVGCQPDDGDSPRNPHDSTGAPETRPDGR

SEQ ID NO: 65702 - protein, 166 aa, Homo sapiens
MAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATEAKPAPEIFENEVMALLRDFAKNKNKEQRLRAPDLEYLFEKPR

SEQ ID NO: 65703 - protein, 280 aa, Homo sapiens
MAAVVALSLRRRLPATTLGGACLQASRGAQTAAATAPRIKKFAIYRWDPDKAGDKPHMQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQAYRWMIDSRDDFTEERLAKLQDPFSLYRCHTIMNCTRTCPKGLNPGKAIAEIKKMMATYKEKKASV

SEQ ID NO: 65704 - protein, 150 aa, Homo sapiens
MAALLLRHVGRHCLRAHFSPQLCIRNAVPLGTTAKEEMERFWNKNIGSNRPLSPHITIYSWSLPMAMSICHRGTGIALSADVGPRKRPEDSPAIPVWSGCPGSYCVVLYGAGSHVKKGGSQHHLPTHYYIHPSFCLSFLSPAWEKFSLFV

SEQ ID NO: 65705 - protein, 169 aa, Homo sapiens
MAALLLRHVGRHCLRAHFSPQLCIRNAVPLGTTAKEEMERFWNKNIGSNRPLSPHITIYSWSLPMAMSICHRGTGIALSAGVSLFGMSALLLPGNFESYLELVKSLCLGPALIHTAKFALVFPLMYHTWNGIRHLMWDLGKGLKIPQLYQSGVVVLVLTVLSSMGLAAM

SEQ ID NO: 65706 - protein, 116 aa, Homo sapiens
MAALLLSWSLPMAMSICHRGTGIALSAGVSLFGMSALLLPGNFESYLELVKSLCLGPALIHTAKFALVFPLMYHTWNGIRHLMWDLGKGLKIPQLYQSGVVVLVLTVLSSMGLAAM

SEQ ID NO: 65707 - protein, 135 aa, Homo sapiens
MAALLLRHVGRHCLRAHFSPQLCIRNWSLPMAMSICHRGTGIALSAGVSLFGMSALLLPGNFESYLELVKSLCLGPALIHTAKFALVFPLMYHTWNGIRHLMWDLGKGLKIPQLYQSGVVVLVLTVLSSMGLAAM

SEQ ID NO: 65708 - protein, 159 aa, Homo sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWGLGQVVTDYVHGDALQKAAKAGLLALSALTFAGLCYFNYHDVGICKAVAMLWKL

SEQ ID NO: 65709 - protein, 154 aa, Homo sapiens
MAASMFYGRLVAVATLRNHRPRTAQRAAAQGPVLIGSSHGGVNIEDVAAESPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDK

SEQ ID NO: 65710 - protein, 298 aa, Homo sapiens
SGRGHPSEPPASDGPAGCCSGSKDVVIKAQVLAGGRGKGTFESGLKGGVKIVFSPEEAKAVSSQMIGKKLFTKQTGEKGRICNQVLVCERKYPRREYYFAITMERSFQGPVLIGSSHGGVNIEDVAAESPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLVNGAGLAMATMDIIKLHGGTPANFLDVGGGATVHQVTEAFKLITSDK

SEQ ID NO: 65711 - protein, 441 aa, Homo sapiens
MAASMFYGRLVAVATLRNHRPRTAQQQQRNLSLHEYMSMELLQEAGVSVPKGYVAKSPDEAYAIAKKLGSKDVVIKAQVLAGGRGKGTFESGLKGGVKIVFSPEEAKAVSSQMIGKKLFTKQTGEKGRICNQVLVCERKYPRREYYFAITMERSFQGPVLIGSSHGGVNIEDVAAESPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLVNGAGLAMATMDIIKLHGGTPANFLDVGGGATVHQVTEAFKLITSDKKVLAILVNIFGGIMRCDVIAQGIVMAVKDLEIKIPVVVRLQGTRVDDAKALIADSGLKILACDDLDEAARMVVKLSEIVTLAKQAHVDVKFQLPI

SEQ ID NO: 65712 - protein, 463 aa, Homo sapiens
MAASMFYGRLVAVATLRNHRPRTAQRAAAQVLGSSGLFNNHGLQVQQQQQRNLSLHEYMSMELLQEAGVSVPKGYVAKSPDEAYAIAKKLGSKDVVIKAQVLAGGRGKGTFESGLKGGVKIVFSPEEAKAVSSQMIGKKLFTKQTGEKGRICNQVLVCERKYPRREYYFAITMERSFQGPVLIGSSHGGVNIEDVAAESPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLVNGAGLAMATMDIIKLHGGTPANFLDVGGGATVHQVTEAFKLITSDKKVLAILVNIFGGIMRCDVIAQGIVMAVKDLEIKIPVVVRLQGTRVDDAKALIADSGLKILACDDLDEAARMVVKLSEIVTLAKQAHVDVKFQLPI

SEQ ID NO: 65713 - protein, 405 aa, Homo sapiens
MSMELLQEAGVSVPKGYVAKSPDEAYAIAKKLGSKDVVIKAQVLAGGRGKGTFESGLKGGVKIVFSPEEAKAVSSQMIGKKLFTKQTGEKGRICNQVLVCERKYPRREYYFAITMERSFQGPVLIGSSHGGVNIEDVAAESPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLVNGAGLAMATMDIIKLHGGTPANFLDVGGGATVHQVTEAFKLITSDKKVLAILVNIFGGIMRCDVIAQGIVMAVKDLEIKIPVVVRLQGTRVDDAKALIADSGLKILACDDLDEAARMVVKLSEIVTLAKQAHVDVKFQLPI

SEQ ID NO: 65714 - protein, 291 aa, Homo sapiens [sequence omitted]

SEQ ID NO: 65715 - protein, 405 aa, Homo sapiens; identical to SEQ ID NO: 65713

SEQ ID NO: 65716 - protein, 329 aa, Homo sapiens
MIGKKLFTKQTGEKGRICNQVLVCERKYPRREYYFAITMERSFQGPVLIGSSHGGVNIEDVAAESPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLVNGAGLAMATMDIIKLHGGTPANFLDVGGGATVHQVTEAFKLITSDKKVLAILVNIFGGIMRCDVIAQGIVMAVKDLEIKIPVVVRLQGTRVDDAKALIADSGLKILACDDLDEAARMVVKLSEIVTLAKQAHVDVKFQLPI

SEQ ID NO: 65717 - protein, 346 aa, Homo sapiens
MTATLAAAADIATMVSGSSGLAAARLLSRSFLLPQNGIRHCSYTASRQHLYVDKNTKIICQGFTGKQGTFHSQQALEYGTKLVGGTTPGKGGQTHLGLPVFNTVKEAKEQTGATASVIYVPPPFAAAAINEAIEAEIPLVVCITEGIPQQDMVRVKHKLLRQEKTRLIGPNCPGVINPGECKIGIMPGHIHKKGRIGIVSRSGTLTYEAVHQTTQVGLGQSLCVGIGGDPFNGTDFIDCLEIFLNDSATEGIILIGEIGGNAEENAAEFLKQHNSGPNSKPVVSFIAGLTAPPGRRMGHAGAIIAGGKGGAKEKISALQSAGVVVSMSPAQLGTTIYKEFEKRKML

SEQ ID NO: 65718 - protein, 1827 aa, Homo sapiens
MARKKFSGLEISLIVLFVIVTIIAIALIVVLATKTPAVDEISDSTSTPATTRVTTNPSDSGKCPNVLNDPVNVRINCIPEQFPTEGICAQRGCCWRPWNDSLIPWCFFVDNHGYNVQDMTTTSIGVEAKLNRIPSPTLFGNDINSVLFTTQNQTPNRFRFKITDPNNRRYEVPHQYVKEFTGPTVSDTLYDVKVAQNPFSIQVIRKSNGKTLFDTSIGPLVYSDQYLQISTRLPSDYIYGIGEQVHKRFRHDLSWKTWPIFTRDQLPGDNNNNLYGHQTFFMCIEDTSGKSFGVFLMNSNAMEIFIQPTPIVTYRVTGGILDFYILLGDTPEQVVQQYQQLVGLPAMPAYWNLGFQLSRWNYKSLDVVKEVVRRNREAGIPFDTQVTDIDYMEDKKDFTYDQVAFNGLPQFVQDLHDHGQKYVIILDPAISIGRRANGTTYATYERGNTQHVWINESDGSTPIIGEVWPGLTVYPDFTNPNCIDWWANECSIFHQEVQYDGLWIDMNEVSSFIQGSTKGCNVNKLNYPPFTPDILDKLMYSKTICMDAVQNWGKQYDVHSLYGYSMAIATEQAVQKVFPNKRSFILTRSTFAGSGRHAAHWLGDNTASWEQMEWSITGMLEFSLFGIPLVGADICGFVAETTEELCRRWMQLGAFYPFSRNHNSDGYEHQDPAFFGQNSLLVKSSRQYLTIRYTLLPFLYTLFYKAHVFGETVARPVLHEFYEDTNSWIEDTEFLWGPALLITPVLKQGADTVSAYIPDAIWYDYESGAKRPWRKQRVDMYLPADKIGLHLRGGYIIPIQEPDVTTTASRKNPLGLIVALGENNTAKGDFFWDDGETKDTIQNGNYILYTFSVSNNTLDIVCTHSSYQEGTTLAFQTVKILGLTDSVTEVRVAENNQPMNAHSNFTYDASNQVLLIADLKLNLGRNFSVQWNQIFSENERFNCYPDADLATEQKCTQRGCVWRTGSSLSKAPECYFPRQDNSYSVNSARYSSMGITADLQLNTANARIKLPSDPISTLRVEVKYHKNDMLQFKIYDPQKKRYEVPVPLNIPTTPISTYEDRLYDVEIKENPFGIQIRRRSSGRVIWDSWLPGFAFNDQFIQISTRLPSEYIYGFGEVEHTAFKRDLNWNTWGMFTRDQPPGYKLNSYGFHPYYMALEEEGNAHGVFLLNSNAMDVTFQPTPALTYRTVGGILDFYMFLGPTPEVATKQYHEVIGHPVMPAYWALGFQLCRYGYANTSEVRELYDAMVAANIPYDVQYTDIDYMERQLDFTIGEAFQDLPQFVDKIRGEGMRYIIILDPAISGNETKTYPAFERGQQNDVFVKWPNTNDICWAKVWPDLPNITIDKTLTEDEAVNASRAHVAFPDFFRTSTAEWWAREIVDFYNEKMKFDGLWIDMNEPSSFVNGTTTNQCRNDELNYPPYFPELTKRTDGLHFRTICMEAEQILSDGTSVLHYDVHNLYGWSQMKPTHDALQKTTGKRGIVISRSTYPTSGRWGGHWLGDNYARWDNMDKSIIGMMEFSLFGMSYTGADICGFFNNSEYHLCTRWMQLGAFYPYSRNHNIANTRRQDPASWNETFAEMSRNILNIRYTLLPYFYTQMHEIHANGGTVIRPLLHEFFDEKPTWDIFKQFLWGPAFMVTPVLEPYVQTVNAYVPNARWFDYHTGKDIGVRGQFQTFNASYDTINLHVRGGHILPCQEPAQNTFYSRQKHMKLIVAADDNQMAQGSLFWDDGESIDTYERDLYLSVQFNLNQTTLTSTILKRGYINKSETRLGSLHVWGKGTTPVNAVTLTYNGNKNSLPFNEDTTNMILRIDLTTHNVTLEEPIEINWS

SEQ ID NO: 65719 - protein, 871 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 65720 - protein, 871 aa, Homo sapiens; identical to SEQ ID NO: 65719

SEQ ID NO: 65721 - protein, 871 aa, Homo sapiens; identical to SEQ ID NO: 65719

SEQ ID NO: 65722 - protein, 871 aa, Homo sapiens; identical to SEQ ID NO: 65719

SEQ ID NO: 65723 - protein, 29 aa, Homo sapiens
MKYSCCALVLAVLGTELLGSLCSTVRSPR

SEQ ID NO: 65724 - protein, 172 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYT

SEQ ID NO: 65725 - protein, 76 aa, Homo sapiens
MKYSCCALVLAVLGTELLGSLCSTVRSPRFRGRIQQERKNIRPNIILVLTDDQDVELGSLQVMNKTRKIMEHGGAT

SEQ ID NO: 65726 - protein, 85 aa, Homo sapiens
MKYSCCALVLAVLGTELLGSLCSTVRSPRFRGRIQQERKNIRPNIILVLTDDQDVELGSLQVMNKTRKIMEHGGATFINAFVTTP

SEQ ID NO: 65727 - protein, 56 aa, Homo sapiens
MKYSCCALVLAVLGTELLGSLCSTVRSPRFRGRIQQERKNIRPNIILVLTDDQDVE

SEQ ID NO: 65728 - protein, 870 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 65729 - protein, 852 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRGQLWEGWEG

SEQ ID NO: 65730 - protein, 289 aa, Homo sapiens
FSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 65731 - protein, 867 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLDGGSYEQYRQFQRRKWPEMKRPSSKSLGQLWEGWEG

SEQ ID NO: 65732 - protein, 870 aa, Homo sapiens; identical to SEQ ID NO: 65728

SEQ ID NO: 65733 - protein, 374 aa, Homo sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSYCYRYRCAARSQNTPDSSASNLGFRCAADRLPTMD

SEQ ID NO: 65734 - protein, 426 aa, Homo sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSQEYYDPYFQDVASEMLRRHTASRWKAFSSLEPCCSIRRHQQYAAIERLTCGKFELRCASLRKIDCLNTNIACSYSMRQDGPRLHCVD

SEQ ID NO: 65735 - protein, 428 aa, Homo sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGLSKAHQRISQEYYDPYFQDVASEMLRRHTASRWKAFSSLEPCCSIRRHQQYAAIERLTCGKFELRCASLRKIDCLNTNIACSYSMRQDGPRLHCVD

SEQ ID NO: 65736 - protein, 349 aa, Homo sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSYCYRYRCAARSQNTPDSSASNLGFRCAADRLPTMD

SEQ ID NO: 65737 - protein, 354 aa, Homo sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPSYCYRYRCAARSQNTPDSSASNLGFRCAADRLPTMD

SEQ ID NO: 65738 - protein, 545 aa, Homo sapiens
MLLLHRAVVLRLQQACRLKSIPSRICIQACSTNDSFQPQRPSLTFSGDNSSTQGWRVMGTLLGLGAVLAYQDHRCRAAQESTHIYTKEEVSSHTSPETGIWVTLGSEVFDVTEFVDLHPGGPSKLMLAAGGPLEPFWALYAVHNQSHVRELLAQYKIGELNPEDKVAPTVETSDPYADDPVRHPALKVNSQRPFNAEPPPELLTENYITPNPIFFTRNHLPVPNLDPDTYRLHVVGAPGGQSLSLSLDDLHNFPRYEITVTLQCAGNRRSEMTQVKEVKGLEWRTGAISTARWAGARLCDVLAQAGHQLCETEAHVCFEGLDSDPTGTAYGASIPLARAMDPEAEVLLAYEMNGQPLPRDHGFPVRVVVPGVVGARHVKWLGRVSVQPEESYSHWQRRDYKGFSPSVDWETVDFDSAPSIQELPVQSAITEPRDGETVESGEVTIKGYAWSGGGRAVIRVDVSLDGGLTWQVAKLDGEEQRPRKAWAWRLWQLKAPVPAGQKELNIVCKAVDDGYNVQPDTVAPIWNLRGVLSNAWHRVHVYVSP

SEQ ID NO: 65739 - protein, 545 aa, Homo sapiens; identical to SEQ ID NO: 65738

SEQ ID NO: 65740 - protein, 545 aa, Homo sapiens; identical to SEQ ID NO: 65738

SEQ ID NO: 65741 - protein, 545 aa, Homo sapiens; identical to SEQ ID NO: 65738

SEQ ID NO: 65742 - protein, 162 aa, Homo sapiens
MLLLHRAVVLRLQQACRLKSIPSRICIQACSTNDSFQPQRPSLTFSGDNSSTQGWRVMGTLLGLGAVLAYQDHRCRAAQESTHIYTKEEVSSHTSPETGIWVTLGSEVFDVTEFVDLHPGGPSKLMLAAGGPLEPFWALYAVHNQSHVRELLAQYKIGELNP

SEQ ID NO: 65743 - protein, 43 aa, Homo sapiens
MLLLHRAVVLRLQQACRLKSIPSRICIQACSTNDSFQPQRPSL

SEQ ID NO: 65744 - protein, 545 aa, Homo sapiens; identical to SEQ ID NO: 65738

SEQ ID NO: 65745 - protein, 545 aa, Homo sapiens; identical to SEQ ID NO: 65738

SEQ ID NO: 65746 - protein, 121 aa, Homo sapiens
MLLLHRAVVLRLQQACRLKSIPSRICIQACSTNDSFQPQRPSLTFSGDNSSTQGWRVMGTLLGLGAVLAYQDHRCRAAQESTHIYTKEEVSSHTSPETGIWVTLGSEVFDVTEFVDLHPGG

SEQ ID NO: 65747 - protein, 260 aa, Homo sapiens
MAESEAETPSTPGEFESKYFEFHGVRLPPFCRGKMEEIANFPVRPSDVWIVTYPKSGTSLLQEVVYLVSQGADPDEIGLMNIDEQLPVLEYPQPGLDIIKELTSPRLIKSHLPYRFLPSDLHNGDSKVIYMARNPKDLVVSYYQFHRSLRTMSYRGTFQEFCRRFMNDKLGYGSWFEHVQEFWEHRMDSNVLFLKYEDMHRDLVTMVEQLARFLGVSCDKAQLEALTEHCHQLVDQCCNAEALPVGRAHCVFARKIFLSW

SEQ ID NO: 65748 - protein, 284 aa, Homo sapiens
MAESEAETPSTPGEFESKYFEFHGVRLPPFCRGKMEEIANFPVRPSDVWIVTYPKSGTSLLQEVVYLVSQGADPDEIGLMNIDEQLPVLEYPQPGLDIIKELTSPRLIKSHLPYRFLPSDLHNGDSKVIYMARNPKDLVVSYYQFHRSLRTMSYRGTFQEFCRRFMNDKLGYGSWFEHVQEFWEHRMDSNVLFLKYEDMHRDLVTMVEQLARFLGVSCDKAQLEALTEHCHQLVDQCCNAEALPVGRGRVGLWKDIFTVSMNEKFDLVYKQKMGKCDLTFDFYL

SEQ ID NO: 65749 - protein, 171 aa, Homo sapiens
MAESEAETPSTPGEFESKYFEFHGVRLPPFCRGKMEEIANFPVRPSDVWIVTYPKSVGYGSWFEHVQEFWEHRMDSNVLFLKYEDMHRDLVTMVEQLARFLGVSCDKAQLEALTEHCHQLVDQCCNAEALPVGRGRVGLWKDIFTVSMNEKFDLVYKQKMGKCDLTFDFYL

SEQ ID NO: 65750 - protein, 56 aa, Homo sapiens
MLAKLLCDQVVGAPIAVSAFYAGMSILQGKDDIFLDLKQKFWNTYMQTQSWLWRSL

SEQ ID NO: 65751 - protein, 295 aa, Homo sapiens
MELIQDTSRPPLEYVKGVPLIKYFAEALGPLQSFQARPDDLLISTYPKSGTTWVSQILDMIYQGGDLEKCHRAPIFMRVPFLEFKAPGIPSGMETLKDTPAPRLLKTHLPLALLPQTLLDQKVKVVYVARNAKDVAVSYYHFYHMAKVHPEPGTWDSFLEKFMVGEVSYGSWYQHVQEWWELSRTHPVLYLFYEDMKENPKREIQKILEFVGRSLPEETVDFVVQHTSFKEMKKNPMTNYTTVPQEFMDHSISPFMRKGMAGDWKTTFTVAQNERFDADYAEKMAGCSLSFRSEL

SEQ ID NO: 65752 - protein, 295 aa, Homo sapiens; identical to SEQ ID NO: 65751

SEQ ID NO: 65753 - protein, 217 aa, Homo sapiens
MLAKLLCDQVVGAPIAVSAFYAGMSILQGKDDIFLDLKQKFWNTYMVVYVARNAKDVAVSYYHFYHMAKVHPEPGTWDSFLEKFMVGEVSYGSWYQHVQEWWELSRTHPVLYLFYEDMKENPKREIQKILEFVGRSLPEETVDFVVQHTSFKEMKKNPMTNYTTVPQEFMDHSISPFMRKGMAGDWKTTFTVAQNERFDADYAEKMAGCSLSFRSEL

SEQ ID NO: 65754 - protein, 295 aa, Homo sapiens; identical to SEQ ID NO: 65751

SEQ ID NO: 65755 - protein, 295 aa, Homo sapiens; identical to SEQ ID NO: 65751

SEQ ID NO: 65756 - protein, 295 aa, Homo sapiens
MELIQDISRPPLEYVKGVPLIKYFAEALGPLQSFQARPDDLLISTYPKSGTTWVSQILDMIYQGGDLEKCHRAPIFMRVPFLEFKVPGIPSGMETLKNTPAPRLLKTHLPLALLPQTLLDQKVKVVYVARNAKDVAVSYYHFYHMAKVYPHPGTWESFLEKFMAGEVSYGSWYQHVQEWWELSRTHPVLYLFYEDMKENPKREIQKILEFVGRSLPEETVDLMVEHTSFKEMKKNPMTNYTTVRREFMDHSISPFMRKGMAGDWKTTFTVAQNERFDADYAKKMAGCSLSFRSEL

SEQ ID NO: 65757 - protein, 295 aa, Homo sapiens; identical to SEQ ID NO: 65756

SEQ ID NO: 65758 - protein, 192 aa, Homo sapiens
MELIQDISRPPLEYVKGVPLIKYFAEALGPLQSFQARPDDLLISTYPKSGTTWVSQILDMIYQGGDLEKCHRAPIFMRVPFLEFKVPGIPSGMETLKNTPAPRLLKTHLPLALLPQTLLDQKVKVVYVARNAKDVAVSYYHFYHMAKVYPHPGTWESFLEKFMAGEVSYGSWYQHVQEWWELSRTHPVLYLF

SEQ ID NO: 65759 - protein, 296 aa, Homo sapiens
MALTSDLGKQIKLKEVEGTLLQPATVDNWSQIQSFEAKPDDLLICTYPKAGTTWIQEIVDMIEQNGDVEKCQRAIIQHRHPFIEWARPPQPSGVEKAKAMPSPRILKTHLSTQLLPPSFWENNCKFLYVARNAKDCMVSYYHFQRMNHMLPDPGTWEEYFETFINGKVVWGSWFDHVKGWWEMKDRHQILFLFYEDIKRDPKHEIRKVMQFMGKKVDETVLDKIVQETSFEKMKENPMTNRSTVSKSILDQSISSFMRKGTVGDWKNHFTVAQNERFDEIYRRKMEGTSINFCMEL

SEQ ID NO: 65760 - protein, 307 aa, Homo sapiens
MALTSDLGKQIKLKEVEGTLLQPATVDNWSQIQSFEAKPDDLLICTYPKAGTTWIQEIVDMIEQNGDVEKCQRAIIQHRHPFIEWARPPQPSETGFHHVAQAGLKLLSSSNPPASTSQSAKITDLLPPSFWENNCKFLYVARNAKDCMVSYYHFQRMNHMLPDPGTWEEYFETFINGKVVWGSWFDHVKGWWEMKDRHQILFLFYEDIKRDPKHEIRKVMQFMGKKVDETVLDKIVQETSFEKMKENPMTNRSTVSKSILDQSISSFMRKGTVGDWKNHFTVAQNERFDEIYRRKMEGTSINFCMEL

SEQ ID NO: 65761 - protein, 310 aa, Homo sapiens
MALTSDLGKQIKLKEVEGTLLQPATVDNWSQIQSFEAKPDDLLICTYPKAGTTWIQEIVDMIEQNGDVEKCQRAIIQHRHPFIEWARPPQPSVLVLRRCFLLSYFKGVEKAKAMPSPRILKTHLSTQLLPPSFWENNCKFLYVARNAKDCMVSYYHFQRMNHMLPDPGTWEEYFETFINGKVVWGSWFDHVKGWWEMKDRHQILFLFYEDIKRDPKHEIRKVMQFMGKKVDETVLDKIVQETSFEKMKENPMTNRSTVSKSILDQSISSFMRKGTVGDWKNHFTVAQNERFDEIYRRKMEGTSINFCMEL

SEQ ID NO: 65762 - protein, 285 aa, Homo sapiens
MSDDFLWFEGIAFPTMGFRSETLRKVRDEFVIRDEDVIILTYPKSGTNWLAEILCLMHSKGDAKWIQSVPIWERSPWVESEIGYTALSETESPRLFSSHLPIQLFPKSFFSSKAKVIYLMRNPRDVLVSGYFFWKNMKFIKKPKSWEEYFEWFCQGTVLYGSWFDHIHGWMPMREEKNFLLLSYEELKQDTGRTIEKICQFLGKTLEPEELNLILKNSSFQSMKENKMSNYSLLSVDYVVDKAQLLRKGVSGDWKNHFTVAQAEDFDKLFQEKMADLPRELFPWE

SEQ ID NO: 65763 - protein, 365 aa, Homo sapiens
MDGPAEPQIPGLWDTYEDDISEISQKLPGEYFRYKGVPFPVGLYSLESISLAENTQDVRDDDIFIITYPKSGTTWMIEIICLILKEGDPSWIRSVPIWERAPWCETIVGAFSLPDQYSPRLMSSHLPIQIFTKAFFSSKAKVIYMGRNPRDVVVSLYHYSKIAGQLKDPGTPDQFLRDFLKGEVQFGSWFDHIKGWLRMKGKDNFLFITYEELQQDLQGSVERICGFLGRPLGKEALGSVVAHSTFSAMKANTMSNYTLLPPSLLDHRRGAFLRKGVCGDWKNHFTVAQSEAFDRAYRKQMRGMPTFPWDEDPEEDGSPDPEPSPEPEPKPSLEPNTSLEREPRPNSSPSPSPGQASETPHPRPS

SEQ ID NO: 65764 - protein, 350 aa, Homo sapiens
MASPPPFHSQKLPGEYFRYKGVPFPVGLYSLESISLAENTQDVRDDDIFIITYPKSGTTWMIEIICLILKEGDPSWIRSVPIWERAPWCETIVGAFSLPDQYSPRLMSSHLPIQIFTKAFFSSKAKVIYMGRNPRDVVVSLYHYSKIAGQLKDPGTPDQFLRDFLKGEVQFGSWFDHIKGWLRMKGKDNFLFITYEELQQDLQGSVERICGFLGRPLGKEALGSVVAHSTFSAMKANTMSNYTLLPPSLLDHRRGAFLRKGVCGDWKNHFTVAQSEAFDRAYRKQMRGMPTFPWDEDPEEDGSPDPEPSPEPEPKPSLEPNTSLEREPRPNSSPSPSPGQASETPHPRPS

SEQ ID NO: 65765 - protein, 346 aa, Homo sapiens
MVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPVKEALEVDWSSEKAKAALKRTTSDYFLLQVLLKFRTDKGRDPSSDTYEEDSELLLQIRNDVLDSLGISPDLLPEDFVRYCFSEMAPVCAVVGGILAQEIVKALSQRDPPHNNFFFFDGMKGNGIVECLGPK

SEQ ID NO: 65766 - protein, 266 aa, Homo sapiens
MVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPVKEALEVDWSSEKAKAALKRTTSDYFLLQGTASPRWPQCVRWLEGFWHRKL

SEQ ID NO: 65767 - protein, 299 aa, Homo sapiens
MVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPVKEALEVDWSSEKAKAALKRTTSDYFLLQGPVSAGPSSQQLLLLRWHEGEWDCGVPWPQVNSRFGSPRDANCSMPTCIPCPLPS

SEQ ID NO: 65768 - protein, 299 aa, Homo sapiens
MVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPVKEALEVDWSSEKAKAALKRTTSDYFLLQELFPRIVERVYAQRHPRSTERTHAKMLIPFLTKEKPGFLGEMAVSRSGVGKLQCS

SEQ ID NO: 65769 - protein, 172 aa, Homo sapiens [sequence omitted]

SEQ ID NO: 65770 - protein, 644 aa, Homo sapiens
MDDIADRMRMDAGEVTLVNHNSVFKTHLLPQTGFPEDQLSLSDQQILSSRQGHLDRSFTCSTRSAAYNPSYYSDNPSSDSFLGSGDLRTFGQSANGQWRNSTPSSSSSLQKSRNSRSLYLETRKTSSGLSNSFAGKSNHHCHVSAYEKSFPIKPVPSPSWSGSCRRSLLSPKKTQRRHVSTAEETVQEEEREIYRQLLQMVTGKQFTIAKPTTHFPLHLSRCLSSSKNTLKDSLFKNGNSCASQIIGSDTSSSGSASILTNQEQLSHSVYSLSSYTPDVAFGSKDSGTLHHPHHHHSVPHQPDNLAASNTQSEGSDSVILLKVKDSQTPTPSSTFFQAELWIKELTSVYDSRARERLRQIEEQKALALQLQNQRLQEREHSVHDSVELHLRVPLEKEIPVTVVQETQKKGHKLTDSEDEFPEITEEMEKEIKNVFRNGNQDEVLSEAFRLTITRKDIQTLNHLNWLNDEIINFYMNMLMERSKEKGLPSVHAFNTFFFTKLKTAGYQAVKRWTKKVDVFSVDILLVPIHLGVHWCLAVVDFRKKNITYYDSMGGINNEACRILLQYLKQESIDKKRKEFDTNGWQLFSKKSQEIPQQMNGSDCGMFACKYADCITKDRPINFTQQHMPYFRKRMVWEILHRKLL

SEQ ID NO: 65771 - protein, 162 aa, Homo sapiens
MKIPLTATICLPGSSPPGLCIFAKVSDVKRLEMDDIADRMRMDAGEVTLVNHNSVFKTHLLPQTGFPEDQLSLSDQQILSSRQGHLDRSFTCSTRSAAYNPSYYSGPGLGVLARYSWGKMLTFGGHHGVTLMQIRHMAVAGFSSFINFQIILPQTVFLAQAI

SEQ ID NO: 65772 - protein, 643 aa, Homo sapiens
MDDIADRMRMDAGEVTLVNHNSVFKTHLLPQTGFPEDQLSLSDQQILSSRQGHLDRSFTCSTRSAAYNPSYYSDNPSSDSFLGSGDLRTFGQSANGQWRNSTPSSSSSLQKSRNSRSLYLETRKTSSGLSNSFAGKSNHHCHVSAYEKSFPIKPVPSPSWSGSCRRSLLSPKKTQRRHVSTAEETVQEEEREIYRQLLQMVTGKQFTIAKPTTHFPLHLSRCLSSSKNTLKDSLFKNGNSCASQIIGSDTSSSGSASILTNQEQLSHSVYSLSSYTPDVAFGSKDSGTLHHPHHHHSVPHQPDNLAASNTQSEGSDSVILLKVKDSQTPTPSSTFFQAELWIKELTSVYDSRARERLRQIEEQKALALQLQNQRLQEREHSVHDSVELHLRVPLEKEIPVTVVQETQKKGHKLTDSEDEFPEITEEMEKEIKNVFRNGNQDEVLSEAFRLTITRKDIQTLNHLNWLNDEIINFYMNMLMERSKEKGLPSVHAFNTFFFTKLKTAGYQAVKRWTKKVDVFSVDILLVPIHLGVHWCLAVVDFRKKNITYYDSMGGINNEACRILLQYLKQESIDKKRKEFDTNGWQLFSKKSQIPQQMNGSDCGMFACKYADCITKDRPINFTQQHMPYFRKRMVWEILHRKLL

SEQ ID NO: 65773 - protein, 644 aa, Homo sapiens; identical to SEQ ID NO: 65770

SEQ ID NO: 65774 - protein, 643 aa, Homo sapiens; identical to SEQ ID NO: 65772

SEQ ID NO: 65775 - protein, 644 aa, Homo sapiens; identical to SEQ ID NO: 65770

SEQ ID NO: 65776 - protein, 755 aa, Homo sapiens
MKKQRKILWRKGIHLAFSEKWNTGFGGFKKFYFHQHLCILKAKLGRPVTWNRQLRHFQGRKKALQIQKTWIKDEPLCAKTKFNVATQNVSTLSSKVKRKDAKHFISSSKTLLRLQAEKLLSSAKNSDHEYCREKNLLKAVTDFPSNSALGQANGHRPRTDPQPSDFPMKFNGESQSPGESGTIVVTLNNHKRKGFCYGCCQGPEHHRNGGPLIPKKFQLNQHRRIKLSPLMMYEKLSMIRFRYRILRSQHFRTKSKVCKLRKAQRSWVQKVTGDHQETRRENGEGGSCSPFPSPEPKDPSCRHQPYFPDMDSSAVVKGTNSHVPDCHTKGSSFLGKELSLDEAFPDQQNGSATNAWDQSSCSSPKWECTELIHDIPLPEHRSNTMFISETEREIMTLGQENQTSSVSDDRVKLSVSGADTSVSSVDGPVSQKAVQNENSYQMEEDGSLKQSILSSELLDHPYCKSPLEAPLVCSGLKLENQVGGGKNSQKASPVDDEQLSVCLSGFLDEVMKKYGSLVPLSEKEVLGRLKDVFNEDFSNRKPFINREITNYRARHQKCNFRIFYNKHMLDMDDLATLDGQNWLNDQVINMYGELIMDAVPDKVHFFNSFFHRQLVTKGYNGVKRWTKKVDLFKKSLLLIPIHLEVHWSLITVTLSNRIISFYDSQGIHFKFCVENIRKYLLTEAREKNRPEFLQGWQTAVTKCIPQQKNDSDCGVFVLQYCKCLALEQPFQFSQEDMPRVRKRIYKELCECRLMD

SEQ ID NO: 65777 - protein, 1105 aa, Homo sapiens
MAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENTQNTSLCSGTVVHGRRFHHAHAQIPVVKTAAQRKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAAHWFLAVVCFPGLEKPKYEPNPHYHENAVIQKCSTVEDSCISSSASEMESCSQNSSAKPVIKKMLNKKHCIAVIDSNPGQEESDPRYKRNICSVKYSVKKINHTASENEEFNKGESTSQKVADRTKSENGLQNESLSSTHHTDGLSKIRLNYSDESPEAGKMLEDELVDFSEDQDNQDDSSDDGFLADDNCSSEIGQWHLKPTICKQPCILLMDSLRGPSRSNVVKILREYLEVEWEVKKGSKRSFSKDVMKGSNPKVPQQNNFSDCGVYVLQYVESFFENPILSFELPMNLANWFPPPRMRTKREEIRNIILKLQEDQSKEKRKHKDTYSTEAPLGEGTEQYVNSISD

SEQ ID NO: 65778 - protein, 1112 aa, Homo sapiens
MAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENTQNTSLCSGTVVHGRRFHHAHAQIPVVKTAAQRLLSNQILKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAAHWFLAVVCFPGLEKPKYEPNPHYHENAVIQKCSTVEDSCISSSASEMESCSQNSSAKPVIKKMLNKKHCIAVIDSNPGQEESDPRYKRNICSVKYSVKKINHTASENEEFNKGESTSQKVADRTKSENGLQNESLSSTHHTDGLSKIRLNYSDESPEAGKMLEDELVDFSEDQDNQDDSSDDGFLADDNCSSEIGQWHLKPTICKQPCILLMDSLRGPSRSNVVKILREYLEVEWEVKKGSKRSFSKDVMKGSNPKVPQQNNFSDCGVYVLQYVESFFENPILSFELPMNLANWFPPPRMRTKREEIRNIILKLQEDQSKEKRKHKDTYSTEAPLGEGTEQYVNSISD

SEQ ID NO: 65779 - protein, 1112 aa, Homo sapiens
MAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENTQNTSLCSGTVVHGRRFHHAHAQIPVVKTAAQSSLDRKERKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAAHWFLAVVCFPGLEKPKYEPNPHYHENAVIQKCSTVEDSCISSSASEMESCSQNSSAKPVIKKMLNKKHCIAVIDSNPGQEESDPRYKRNICSVKYSVKKINHTASENEEFNKGESTSQKVADRTKSENGLQNESLSSTHHTDGLSKIRLNYSDESPEAGKMLEDELVDFSEDQDNQDDSSDDGFLADDNCSSEIGQWHLKPTICKQPCILLMDSLRGPSRSNVVKILREYLEVEWEVKKGSKRSFSKDVMKGSNPKVPQQNNFSDCGVYVLQYVESFFENPILSFELPMNLANWFPPPRMRTKREEIRNIILKLQEDQSKEKRKHKDTYSTEAPLGEGTEQYVNSISD

SEQ ID NO: 65780 - protein, 357 aa, Homo sapiens
MAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENTQNTSLCSGTVVHGRRFHHAHAQIPVVKTAAQSNQILKEYPPHVQKVEINPVRLSRLQGVVILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIVIIKIFFITHKKPDHDPVEIILNTSDLTKCEWCNVRKLPVVFLQ

SEQ ID NO: 65781 - protein, 368 aa, Homo sapiens
MKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAWLKQNQTKL

SEQ ID NO: 65782 - protein, 984 aa, Homo sapiens
MDKRKLGRRPSSSEIITEGKRKKSSSDLSEIRKMLNAKPEDVHVQSPLSKFRSSERWTLPLQWERSLRNKVISLDHKNKKHIRGCPVTSKSSPERIPRVILTNVLGTELGRKYIRTPPVTEGSLSDTDNLQSEQLSSSSDGSLESYQNLNPHKSCYLSERGSQRSKTVDDNSAKQTAHNKEKRRKDDGISLLISDTQPEDLNSGSRGCDHLEQESRNKDVKYSDSKVELTLISRKTKRRLRNNLPDSQYCTSLDKSTEQTKKQEDDSTISTEFEKPSENYHQDPKLPEEITTKPTKSDFTKLSSLNSQELTLSNATKSASAGSTTETVENSNSIDIVGISSLVEKDENELNTIEKPILRGHNEGNQSLISAEPIVVSSDEEGPVEHKSSEILKLQSKQDRETTNENESTSESALLELPLITCESVQMSSELCPYNPVMENISSIMPSNEMDLQLDFIFTSVYIGKIKGASKGCVTITKKYIKIPFQVSLNEISLLVDTTHLKRFGLWKSKDDNHSKRSHAILFFWVSSDYLQEIQTQLEHSVLSQQSKSSEFIFLELHNPVSQREELKLKDIMTEISIISGELELSYPLSWVQAFPLFQNLSSKESSFIHYYCVSTCSFPAGVAVAEEMKLKSVSQPSNTDAAKPTYTFLQKQSSGCYSLSITSNPDEEWREVRHTGLVQKLIVYPPPPTKGGLGVTNEDLECLEEGEFLNDVIIDFYLKYLILEKASDELVERSHIFSSFFYKCLTRKENNLTEDNPNLSMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 65783 - protein, 1017 aa, Homo sapiens
MLNAKPEDVHVQSPLSKFRSSERWTLPLQWERSLRNKVISLDHKNKKHIRGCPVTSKSSPERQLKVMLTNVLWTDLGRKFRKTLPRNDANLCDANKVQSDSLPSTSVDSLETCQKLEPLRQSLNLSERIPRVILTNVLGTELGRKYIRTPPVTEGSLSDTDNLQSEQLSSSSDGSLESYQNLNPHKSCYLSERGSQRSKTVDDNSAKQTAHNKEKRRKDDGISLLISDTQPEDLNSGSRGCDHLEQESRNKDVKYSDSKVELTLISRKTKRRLRNNLPDSQYCTSLDKSTEQTKKQEDDSTISTEFEKPSENYHQDPKLPEEITTKPTKSDFTKLSSLNSQELTLSNATKSASAGSTTETVENSNSIDIVGISSLVEKDENELNTIEKPILRGHNEGNQSLISAEPIVVSSDEEGPVEHKSSEILKLQSKQDRETTNENESTSESALLELPLITCESVQMSSELCPYNPVMENISSIMPSNEMDLQLDFIFTSVYIGKIKGASKGCVTITKKYIKIPFQVSLNEISLLVDTTHLKRFGLWKSKDDNHSKRSHAILFFWVSSDYLQEIQTQLEHSVLSQQSKSSEFIFLELHNPVSQREELKLKDIMTEISIISGELELSYPLSWVQAFPLFQNLSSKESSFIHYYCVSTCSFPAGVAVAEEMKLKSVSQPSNTDAAKPTYTFLQKQSSGCYSLSITSNPDEEWREVRHTGLVQKLIVYPPPPTKGGLGVTNEDLECLEEGEFLNDVIIDFYLKYLILEKASDELVERSHIFSSFFYKCLTRKENNLTEDNPNLSMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 65784 - protein, 886 aa, Homo sapiens
MLNAKPEDVHVQSPLSKFRSSERWTLPLQWERSLRNKVISLDHKNKKHIRGCPVTSKSSPERGSQRSKTVDDNSAKQTAHNKEKRRKDDGISLLISDTQPEDLNSGSRGCDHLEQESRNKDVKYSDSKVELTLISRKTKRRLRNNLPDSQYCTSLDKSTEQTKKQEDDSTISTEFEKPSENYHQDPKLPEEITTKPTKSDFTKLSSLNSQELTLSNATKSASAGSTTETVENSNSIDIVGISSLVEKDENELNTIEKPILRGHNEGNQSLISAEPIVVSSDEEGPVEHKSSEILKLQSKQDRETTNENESTSESALLELPLITCESVQMSSELCPYNPVMENISSIMPSNEMDLQLDFIFTSVYIGKIKGASKGCVTITKKYIKIPFQVSLNEISLLVDTTHLKRFGLWKSKDDNHSKRSHAILFFWVSSDYLQEIQTQLEHSVLSQQSKSSEFIFLELHNPVSQREELKLKDIMTEISIISGELELSYPLSWVQAFPLFQNLSSKESSFIHYYCVSTCSFPAGVAVAEEMKLKSVSQPSNTDAAKPTYTFLQKQSSGCYSLSITSNPDEEWREVRHTGLVQKLIVYPPPPTKGGLGVTNEDLECLEEGEFLNDVIIDFYLKYLILEKASDELVERSHIFSSFFYKCLTRKENNLTEDNPNLSMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 65785 - protein, 238 aa, Homo sapiens
MKKFLYIKSVFHTLRMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 65786 - protein, 985 aa, Homo sapiens
MDKRKLGRRPSSSEIITEGKRKKSSSDLSEIRKMLNAKPEDVHVQSPLSKFRSSERWTLPLQWERSLRNKVISLDHKNKKHIRGCPVTSKSSPERQLKVMLTNVLWTDLGRKFRKTLPRNDANLCDANKVQSDSLPSTSVDSLETCQKLEPLRQSLNLSERGSQRSKTVDDNSAKQTAHNKEKRRKDDGISLLISDTQPEDLNSGSRGCDHLEQESRNKDVKYSDSKVELTLISRKTKRRLRNNLPDSQYCTSLDKSTEQTKKQEDDSTISTEFEKPSENYHQDPKLPEEITTKPTKSDFTKLSSLNSQELTLSNATKSASAGSTTETVENSNSIDIVGISSLVEKDENELNTIEKPILRGHNEGNQSLISAEPIVVSSDEEGPVEHKSSEILKLQSKQDRETTNENESTSESALLELPLITCESVQMSSELCPYNPVMENISSIMPSNEMDLQLDFIFTSVYIGKIKGASKGCVTITKKYIKIPFQVSLNEISLLVDTTHLKRFGLWKSKDDNHSKRSHAILFFWVSSDYLQEIQTQLEHSVLSQQSKSSEFIFLELHNPVSQREELKLKDIMTEISIISGELELSYPLSWVQAFPLFQNLSSKESSFIHYYCVSTCSFPAGVAVAEEMKLKSVSQPSNTDAAKPTYTFLQKQSSGCYSLSITSNPDEEWREVRHTGLVQKLIVYPPPPTKGGLGVTNEDLECLEEGEFLNDVIIDFYLKYLILEKASDELVERSHIFSSFFYKCLTRKENNLTEDNPNLSMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 65787 - protein, 1050 aa, Homo sapiens
MDKRKLGRRPSSSEIITEGKRKKSSSDLSEIRKMLNAKPEDVHVQSPLSKFRSSERWTLPLQWERSLRNKVISLDHKNKKHIRGCPVTSKSSPERQLKVMLTNVLWTDLGRKFRKTLPRNDANLCDANKVQSDSLPSTSVDSLETCQKLEPLRQSLNLSERIPRVILTNVLGTELGRKYIRTPPVTEGSLSDTDNLQSEQLSSSSDGSLESYQNLNPHKSCYLSERGSQRSKTVDDNSAKQTAHNKEKRRKDDGISLLISDTQPEDLNSGSRGCDHLEQESRNKDVKYSDSKVELTLISRKTKRRLRNNLPDSQYCTSLDKSTEQTKKQEDDSTISTEFEKPSENYHQDPKLPEEITTKPTKSDFTKLSSLNSQELTLSNATKSASAGSTTETVENSNSIDIVGISSLVEKDENELNTIEKPILRGHNEGNQSLISAEPIVVSSDEEGPVEHKSSEILKLQSKQDRETTNENESTSESALLELPLITCESVQMSSELCPYNPVMENISSIMPSNEMDLQLDFIFTSVYIGKIKGASKGCVTITKKYIKIPFQVSLNEISLLVDTTHLKRFGLWKSKDDNHSKRSHAILFFWVSSDYLQEIQTQLEHSVLSQQSKSSEFIFLELHNPVSQREELKLKDIMTEISIISGELELSYPLSWVQAFPLFQNLSSKESSFIHYYCVSTCSFPAGVAVAEEMKLKSVSQPSNTDAAKPTYTFLQKQSSGCYSLSITSNPDEEWREVRHTGLVQKLIVYPPPPTKGGLGVTNEDLECLEEGEFLNDVIIDFYLKYLILEKASDELVERSHIFSSFFYKCLTRKENNLTEDNPNLSMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 65788 - protein, 589 aa, Homo sapiens
MYRWLVRILGTIFRFCDRSVPPARALLKRRRSDSTLFSTVDTDEIPAKRPRLDCFIHQVKNSLYNAASLFGFPFQLTTKPMVTSACNGTRNVAPSGEVFSNSSSCELTGSGSWNNMLKLGNKSPNGISDYPKIRVTVTRDQPRRVLPSFGFTLNSEGCNRRPGGRRHSKGNPESSLMWKPQEQAVTEMISEESGKGLRRPHCTVEEGVQKEEREKYRKLLERLKESGHGNSVCPVTSNYHSSQRSQMDTLKTKGWGEEQNHGVKTTQFVPKQYRLVETRGPLCSLRSEKRCSKGKITDTETMVGIRFENESRRGYQLEPDLSEEVSARLRLGSGSNGLLRRKVSIIETKEKNCSGKERDRRTDDLLELTEDMEKEISNALGHGPQDEILSSAFKLRITRGDIQTLKNYHWLNDEVINFYMNLLVERNKKQGYPALHVFSTFFYPKLKSGGYQAVKRWTKGVNLFEQEIILVPIHRKVHWSLVVIDLRKKCLKYLDSMGQKGHRICEILLQYLQDESKTKRNSDLNLLEWTHHSMKPHEIPQQLNGSDCGMFTCKYADYISRDKPITFTQHQMPLFRKKMVWEILHQQLL

SEQ ID NO: 65789 - protein, 413 aa, Homo sapiens [sequence omitted]

SEQ ID NO: 65790 - protein, 460 aa, Homo sapiens
MYRWLVRILGTIFRFCDRSVPPARALLKRRRSDSTLFSTVDTDEIPAKRPRLDCFIHQVKNSLYNAASLFGFPFQLTTKPMVTSACNGTRNVAPSGEVNGNSVCPVTSNYHSSQRSQMDTLKTKGWGEEQNHGVKTTQFVPKQYRLVETRGPLCSLRSEKRCSKGKITDTETMVGIRFENESRRGYQLEPDLSEEVSARLRLGSGSNGLLRRKVSIIETKEKNCSGKERDRRTDDLLELTEDMEKEISNALGHGPQDEILSSAFKLRITRGDIQTLKNYHWLNDEVINFYMNLLVERNKKQGYPALHVFSTFFYPKLKSGGYQAVKRWTKGVNLFEQEIILVPIHRKVHWSLVVIDLRKKCLKYLDSMGQKGHRICEILLQYLQDESKTKRNSDLNLLEWTHHSMKPHEIPQQLNGSDCGMFTCKYADYISRDKPITFTQHQMPLFRKKMVWEILHQQLL

SEQ ID NO: 65791 - protein, 579 aa, Homo sapiens
MDSHPCLYCGPQDSEGTNWQTSPSTLFSTVDTDEIPAKRPRLDCFIHQVKNSLYNAASLFGFPFQLTTKPMVTSACNGTRNVAPSGEVFSNSSSCELTGSGSWNNMLKLGNKSPNGISDYPKIRVTVTRDQPRRVLPSFGFTLNSEGCNRRPGGRRHSKGNPESSLMWKPQEQAVTEMISEESGKGLRRPHCTVEEGVQKEEREKYRKLLERLKESGHGNSVCPVTSNYHSSQRSQMDTLKTKGWGEEQNHGVKTTQFVPKQYRLVETRGPLCSLRSEKRCSKGKITDTETMVGIRFENESRRGYQLEPDLSEEVSARLRLGSGSNGLLRRKVSIIETKEKNCSGKERDRRTDDLLELTEDMEKEISNALGHGPQDEILSSAFKLRITRGDIQTLKNYHWLNDEVINFYMNLLVERNKKQGYPALHVFSTFFYPKLKSGGYQAVKRWTKGVNLFEQEIILVPIHRKVHWSLVVIDLRKKCLKYLDSMGQKGHRICEILLQYLQDESKTKRNSDLNLLEWTHHSMKPHEIPQQLNGSDCGMFTCKYADYISRDKPITFTQHQMPLFRKKMVWEILHQQLL

SEQ ID NO: 65792 - protein, 573 aa, Homo sapiens
MKETIQGTGSWGPEPPGPGIPPAYSSPRRERLRWPPPPKPRLKSGGGFGPDPGSGTTVPARRLPVPRPSFDASASEEEEEEEEEEDEDEEEEVAAWRLPPRWSQLGTSQRPRPSRPTHRKTCSQRRRRAMRAFRMLLYSKSTSLTFHWKLWGRHRGRRRGLAHPKNHLSPQQGGATPQVPSPCCRFDSPRGPPPPRLGLLGALMAEDGVRGSPPVPSGPPMEEDGLRWTPKSPLDPDSGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEKVHFFNSFFYDKLRTGYDGVKRWTKNVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTV

SEQ ID NO: 65793 - protein, 574 aa, Homo sapiens
MKETIQGTGSWGPEPPGPGIPPAYSSPRRERLRWPPPPKPRLKSGGGFGPDPGSGTTVPARRLPVPRPSFDASASEEEEEEEEEEDEDEEEEVAAWRLPPRWSQLGTSQRPRPSRPTHRKTCSQRRRRAMRAFRMLLYSKSTSLTFHWKLWGRHRGRRRGLAHPKNHLSPQQGGATPQVPSPCCRFDSPRGPPPPRLGLLGALMAEDGVRGSPPVPSGPPMEEDGLRWTPKSPLDPDSGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEKVHFFNSFFYDKLRTKGYDGVKRWTKNVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTV

SEQ ID NO: 65794 - protein, 1246 aa, Homo sapiens
MMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTQYPFWPGGMDEPTITDLNTREEAEEEIDFEKDLLTIPPGFKKGMDFAPKDCPTPAPGLLSLSCMLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEAGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMPFSELAGLSGTPEGLVVRCIQRLAEMCRSLRGAARLVGEPVLGAKMETAATLLRRDIVFAASLYTQ

SEQ ID NO: 65795 - protein, 1246 aa, Homo sapiens
MMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTQYPFWPGGMDEPTITDLNTREEAEEEIDFEKDLLTIPPGFKKGMDFAPKDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEAGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMPFSELAGLSGTPEGLVVRCIQRLAEMCRSLRGAARLVGEPVLGAKMETAATLLRRDIVFAASLYTQ

SEQ ID NO: 65796 - protein, 1246 aa, Homo sapiens; identical to SEQ ID NO: 65795

SEQ ID NO: 65797 - protein, 1246 aa, Homo sapiens; identical to SEQ ID NO: 65795

SEQ ID NO: 65798 - protein, 1246 aa, Homo sapiens; identical to SEQ ID NO: 65795

SEQ ID NO: 65799 - protein, 1088 aa, Homo sapiens
MDEPTITDLNTREEAEEEIDFEKDLLTIPPGFKKGMDFAPKDCPTPAPGLLSLSCMLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEAGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMPFSELAGLSGTPEGLVVRCIQRLAEMCRSLRGAARLVGEPVLGAKMETAATLLRRDIVFAASLYTQ

SEQ ID NO: 65800 - protein, 1246 aa, Homo sapiens; identical to SEQ ID NO: 65794

SEQ ID NO: 65801 - protein, 1053 aa, Homo sapiens
MDFAPKDCPTPAPGLLSLSCMLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEAGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMPFSELAGLSGTPEGLVVRCIQRLAEMCRSLRGAARLVGEPVLGAKMETAATLLRRDIVFAASLYTQ

SEQ ID NO: 65802 - protein, 1053 aa, Homo sapiens; identical to SEQ ID NO: 65801

SEQ ID NO: 65803 - protein, 230 aa, Homo sapiens
MMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTQYPFWPGGMDEPTITDLNTREEAEEEIDFEKDLLTIPPGFKKGMDFAPKGSVHSCIHPRGPRASISGAVGHPCGRHLPCW

SEQ ID NO: 65804 - protein, 1088 aa, Homo sapiens [sequence omitted]

SEQ ID NO: 65805 - protein, 1053 aa, Homo sapiens
MDFAPKDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEAGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMPFSELAGLSGTPEGLVVRCIQRLAEMCRSLRGAARLVGEPVLGAKMETAATLLRRDIVFAASLYTQ

SEQ ID NO: 65806 - protein, 880 aa, Homo sapiens
MMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEAGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMPFSELAGLSGTPEGLVVRCIQRLAEMCRSLRGAARLVGEPVLGAKMETAATLLRRDIVFAASLYTQ

SEQ ID NO: 65807 - protein, 1088 aa, Homo sapiens [sequence omitted]

SEQ ID NO: 65808 - protein, 880 aa, Homo sapiens; identical to SEQ ID NO: 65806

SEQ ID NO: 65809 - protein, 880 aa, Homo sapiens; identical to SEQ ID NO: 65806

SEQ ID NO: 65810 - protein, 230 aa, Homo sapiens; identical to SEQ ID NO: 65803

SEQ ID NO: 65811 - protein, 880 aa, Homo sapiens; identical to SEQ ID NO: 65806

SEQ ID NO: 65812 - protein, 1088 aa, Homo sapiens [sequence omitted]

SEQ ID NO: 65813 - protein, 1088 aa, Homo sapiens [sequence omitted]

SEQ ID NO: 65814 - protein, 230 aa, Homo sapiens; identical to SEQ ID NO: 65803

SEQ ID NO: 65815 - protein, 1088 aa, Homo sapiens; identical to SEQ ID NO: 65799

SEQ ID NO: 65816 - protein, 230 aa, Homo sapiens; identical to SEQ ID NO: 65803

SEQ ID NO: 65817 - protein, 880 aa, Homo sapiens; identical to SEQ ID NO: 65806

SEQ ID NO: 65818 - protein, 230 aa, Homo sapiens; identical to SEQ ID NO: 65803

SEQ ID NO: 65819 - protein, 1053 aa, Homo sapiens; identical to SEQ ID NO: 65805

SEQ ID NO: 65820 - protein, 1053 aa, Homo sapiens; identical to SEQ ID NO: 65805

SEQ ID NO: 65821 - protein, 1053 aa, Homo sapiens; identical to SEQ ID NO: 65805

SEQ ID NO: 65822 - protein, 154 aa, Homo sapiens [sequence omitted]

SEQ ID NO: 65823 - protein, 35 aa, Homo sapiens
MATKAVCVLKGDGPVQGIINFEQKESNGPEGVGKH

SEQ ID NO: 65824 - protein, 369 aa, Homo sapiens
MDPRKVNELRAFVKMCKQDPSVLHTEEMRFLREWVESMGGKVPPATQKAKSEENTKEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWEEAAHDLALACKLDYDEDASAMLKEVQPRAQKIAEHRRKYERKREEREIKERIERVKKAREEHERAQREEEARRQSGAQYGSFPGGFPGGMPGNFPGGMPGMGGGMPGMAGMPGLNEILSDPEVLAAMQDPEVMVAFQDVAQNPANMSKYQSNPKVMNLISKLSAKFGGQA

SEQ ID NO: 65825 - protein, 211 aa, Homo sapiens [sequence omitted]

SEQ ID NO: 65826 - protein, 162 aa, Homo sapiens
MGGKVPPATQKAKSEENTKEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWE

SEQ ID NO: 65827 - protein, 121 aa, Homo sapiens
MDPRKVNELRAFVKMCKQDPSVLHTEEMRFLREWVESMGGKVPPATQKAKSEENTKEEKPDSKKVEEDLKADEPSSEESDLEIDKEGVIEPDTDAPQEMGDENAEITEEMMDQANDKSGCY

SEQ ID NO: 65828 - protein, 855 aa, Homo sapiens [sequence omitted]

SEQ ID NO: 65829 - protein, 1137 aa, Homo sapiens
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPGPAAGPRGVLLTRTGTRAHSLGIREKISAWEGRREASPRMSMCGEKREGSGSEWAASEGCPSLGCPSVVPSPCSSEKTFDFKGLRRMSRTFSECSYPETEEEGEALPVRDSFYRLEKRLGRSEPSAFLRGHGSRKESSAVLSRIQKIEQVLKEQPGRGLPQLPSSCYSVDRGKRKTGTLGSLEEPAGGASVSAGSRAVGVAGVAGEAGPPPEREGSGSTKPGTPGNSPSSQRLPSKSSLDPAVNPVPKPKRTFEYEADKNPKSKPSNGLPPSPTPAAPPPLPSTPAPPVTRRPKKDMRGHRKSQSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 65830 - protein, 1137 aa, Homo sapiens; identical to SEQ ID NO: 65829

SEQ ID NO: 65831 - protein, 420 aa, Homo sapiens [sequence omitted]

SEQ ID NO: 65832 - protein, 57 aa, Homo sapiens
MTMTANKNSSITHGAGGTKAPRGTLSRSQSVSPPPVLSPPRSPIYPLSDSETSACRY

SEQ ID NO: 65833 - protein, 40 aa, Homo sapiens
MTMTANKNSSITHGAGGTKAPRGTLSRSQSVSPPPVLSPP

SEQ ID NO: 65834 - protein, 47 aa, Homo sapiens
MWSPQDRKYNSPPTQLSLKPNSQSLRSGNWSERKSHRLPRLPKRHSH

SEQ ID NO: 65835 - protein, 72 aa, Homo sapiens
MTMTANKNSSITHGAGGTKAPRGTLSRKSFEFEDASSLQSLYPSSPTENGTENQPKFGSKSTLEENAYEDIV

SEQ ID NO: 65836 - protein, 124 aa, Homo sapiens
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQD

SEQ ID NO: 65837 - protein, 142 aa, Homo sapiens
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPG

SEQ ID NO: 65838 - protein, 717 aa, Homo sapiens
MTMTANKNSSITHGAGGTKAPRGTLSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 65839 - protein, 52 aa, Homo sapiens
MTMTANKNSSITHGAGGTKAPRGTLSRSQSVSPPPVLSPPRSPIYPLSDSET

SEQ ID NO: 65840 - protein, 111 aa, Homo sapiens
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKR

SEQ ID NO: 65841 - protein, 53 aa, Homo sapiens
MTMTANKNSSITHGAGGTKAPRGTLSRSQSVSPPPVLSPPRSPIYPLSDSETS

SEQ ID NO: 65842 - protein, 83 aa, Homo sapiens
MTMTANKNSSITHGAGGTKAPRGTLSRSQSVSPPPVLSPPRSPIYPLSDSETSACRYPSHSSSRVLLKDRHPPAPSPQNPQDP

SEQ ID NO: 65843 - protein, 95 aa, Homo sapiens
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFK

SEQ ID NO: 65844 - protein, 154 aa, Homo sapiens
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPGPAAGPRGVLLTR

SEQ ID NO: 65845 - protein, 179 aa, Homo sapiens
MWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKK

SEQ ID NO: 65846 - protein, 717 aa, Homo sapiens; identical to SEQ ID NO: 65838

SEQ ID NO: 65847 - protein, 136 aa, Homo sapiens
MTMTANKNSSITHGAGGTKAPRGTLSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSG

SEQ ID NO: 65848 - protein, 74 aa, Homo sapiens
MTMTANKNSSITHGAGGTKAPRGTLSRSQSVSPPPVLSPPRSPIYPLSDSETSACRYPSHSSSRVLLKDRHPPA

SEQ ID NO: 65849 - protein, 139 aa, Homo sapiens
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTP

SEQ ID NO: 65850 - protein, 609 aa, Homo sapiens
MWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 65851 - protein, 77 aa, Homo sapiens
MTMTANKNSSITHGAGGTKAPRGTLSRKSFEFEDASSLQSLYPSSPTENGTENQPKFGSKSTLEENAYEDIVGDLPK

SEQ ID NO: 65852 - protein, 26 aa, Homo sapiens
MTMTANKNSSITHGAGGTKAPRGTLS

SEQ ID NO: 65853 - protein, 344 aa, Homo sapiens
MWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHV

SEQ ID NO: 65854 - protein, 76 aa, Homo sapiens
MTMTANKNSSITHGAGGTKAPRGTLSRKSFEFEDASSLQSLYPSSPTENGTENQPKFGSKSTLEENAYEDIVGDLP

SEQ ID NO: 65855 - protein, 74 aa, Homo sapiens; identical to SEQ ID NO: 65848

SEQ ID NO: 65856 - protein, 144 aa, Homo sapiens
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPGPA

SEQ ID NO: 65857 - protein, 1137 aa, Homo sapiens; identical to SEQ ID NO: 65829

SEQ ID NO: 65858 - protein, 122 aa, Homo sapiens
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAA

SEQ ID NO: 65859 - protein, 30 aa, Homo sapiens
MTMTANKNSSITHGAGGTKAPRGTLSRSQS

SEQ ID NO: 65860 - protein, 585 aa, Homo sapiens
MAEAATGFLEQLKSCIVWSWTYLWTVWFFIVLFLVYILRVPLKINDNLSTVSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINEIRSRVEVPLIASSTIWEIKLLPKCATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAMIDIFCSAEFRDWNCKSIFMRVEDELEIPPAPQSQHFQN

SEQ ID NO: 65861 - protein, 499 aa, Homo sapiens
MSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHSFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 65862 - protein, 511 aa, Homo sapiens
MFGTESSLSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 65863 - protein, 534 aa, Homo sapiens
MFGTESSLSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINEIRSRVEVPLIASSTIWEIKLLPKCATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 65864 - protein, 554 aa, Homo sapiens
MAEAATGFLEQLKSCIVWSWTYLWTVWFFIVLFLVYILRVPLKINDNLSTVSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 65865 - protein, 62 aa, Homo sapiens
MSMFLNTLTPKFYVALTGTSSLISGLILIFEWWYFRKYGTSFIEQVSVSHLRPLLGGVDNNS

SEQ ID NO: 65866 - protein, 87 aa, Homo sapiens
MSMFLNTLTPKFYVALTGTSSLISGLILIFEWWYFRKYGTSFIEQVSVSHLRPLLGGVDNNSSNNSNSSNGDSDSNRQSVSECKVWR

SEQ ID NO: 65867 - protein, 440 aa, Homo sapiens
MAENNENISKNVDVRPKTSRSRSADRKDGYVWSGKKLSWSKKSESYSDAETVNGIEKTEVSLRNQERKHSCSSIELDLDHSCGHRFLGRSLKQKLQDAVGQCFPIKNCSSRHSSGLPSKRKIHISELMLDKCPFPPRSDLAFRWHFIKRHTAPINSKSDEWVSTDLSQTELRDGQLKRRNMEENINCFSHTNVQPCVITTDNALCREGPMTGSVMNLVSNNSIEDSDMDSDDEILTLCTSSRKRNKPKWDLDDEILQLETPPKYHTQIDYVHCLVPDLLQINNNPCYWGVMDKYAAEALLEGKPEGTFLLRDSAQEDYLFSVSFRRYSRSLHARIEQWNHNFSFDAHDPCVFHSPDITGLLEHYKDPSACMFFEPLLSTPLIRTFPFSLQHICRTVICNCTTYDGIDALPIPSSMKLYLKEYHYKSKVRVLRIDAPEQQC

SEQ ID NO: 65868 - protein, 440 aa, Homo sapiens; identical to SEQ ID NO: 65867

SEQ ID NO: 65869 - protein, 440 aa, Homo sapiens; identical to SEQ ID NO: 65867

SEQ ID NO: 65870 - protein, 536 aa, Homo sapiens
MDKVGKMWNNFKYRCQNLFGHEGGSRSENVDMNSNRCLSVKEKNISIGDSTPQQQSSPLRENIALQLGLSPSKNSSRRNQNCATEIPQIVEISIEKDNDSCVTPGTRLARRDSYSRHAPWGGKKKHSCSTKTQSSLDADKKFGRTRSGLQRRERRYGVSSVHDMDSVSSRTVGSRSLRQRLQDTVGLCFPMRTYSKQSKPLFSNKRKIHLSELMLEKCPFPAGSDLAQKWHLIKQHTAPVSPHSTFFDTFDPSLVSTEDEEDRLRERRRLSIEEGVDPPPNAQIHTFEATAQVNPLYKLGPKLAPGMTEISGDSSAIPQANCDSEEDTTTLCLQSRRQKQRQISGDSHTHVSRQGAWKVHTQIDYIHCLVPDLLQITGNPCYWGVMDRYEAEALLEGKPEGTFLLRDSAQEDYLFSVSFRRYNRSLHARIEQWNHNFSFDAHDPCVFHSSTVTGLLEHYKDPSSCMFFEPLLTISLNRTFPFSLQYICRAVICRCTTYDGIDGLPLPSMLQDFLKEYHYKQKVRVRWLEREPVKAK

SEQ ID NO: 65871 - protein, 536 aa, Homo sapiens; identical to SEQ ID NO: 65870

SEQ ID NO: 65872 - protein, 1087 aa, Homo sapiens
MSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 65873 - protein, 1065 aa, Homo sapiens
MSDSEDSNFSEEEDSERSSDGEEAEVDEERRSAAGSEKEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 65874 - protein, 1083 aa, Homo sapiens
MSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 65875 - protein, 1087 aa, Homo sapiens; identical to SEQ ID NO: 65872

SEQ ID NO: 65876 - protein, 1087 aa, Homo sapiens; identical to SEQ ID NO: 65872

SEQ ID NO: 65877 - protein, 1087 aa, Homo sapiens; identical to SEQ ID NO: 65872

SEQ ID NO: 65878 - protein, 1726 aa, Homo sapiens
MSDFVESEAEESEEEYNDEGEVVPRVTKKFVEEEDDDEEEEEENLDDQDEQGNLKGFINDDDDEDEGEEDEGSDSGDSEDDVGHKKRKRTSFDDRLEDDDFDLIEENLGVKVKRGQKYRRVKKMSDDEDDDEEEYGKEEHEKEAIAEEIFQDGEGEEGQEAMEAPMAPPEEEEEDDEESDIDDFIVDDDGQPLKKPKWRKKLPGYTDAALQEAQEIFGVDFDYDEFEKYNEYDEELEEEYEYEDDEAEGEIRVRPKKTTKKRVSRRSIFEMYEPSELESSHLTDQDNEIRATDLPERFQLRSIPVKGAEDDELEEEADWIYRNAFATPTISLQESCDYLDRGQPASSFSRKGPSTIQKIKEALGFMRNQHFEVPFIAFYRKEYVEPELHINDLWRVWQWDEKWTQLRIRKENLTRLFEKMQAYQYEQISADPDKPLADGIRALDTTDMERLKDVQSMDELKDVYNHFLLYYGRDIPKMQNAAKASRKKLKRVREEGDEEGEGDEAEDEEQRGPELKQASRRDMYTICQSAGLDGLAKKFGLTPEQFGENLRDSYQRHETEQFPAEPLELAKDYVCSQFPTPEAVLEGARYMVALQIAREPLVRQVLRQTFQERAKLNITPTKKGRKDVDEAHYAYSFKYLKNKPVKELRDDQFLKICLAEDEGLLTTDISIDLKGVEGYGNDQTYFEEIKQFYYRDEFSHQVQEWNRQRTMAIERALQQFLYVQMAKELKNKLLAEAKEYVIKACSRKLYNWLRVAPYRPDQQVEEDDDFMDENQGKGIRVLGIAFSSARDHPVFCALVNGEGEVTDFLRLPHFTKRRTAWREEEREKKAQDIETLKKFLLNKKPHVVTVAGENRDAQMLIEDVKRIVHELDQGQQLSSIGVELVDNELAILYMNSKKSEAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVFMNCAGFLKIDTASLGDSTDSYIEVLDGSRVHPETYEWARKMAVDALEYDESAEDANPAGALEEILENPERLKDLDLDAFAEELERQGYGDKHITLYDIRAELSCRYKDLRTAYRSPNTEEIFNMLTKETPETFYIGKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 65879 - protein, 726 aa, Homo sapiens
MSDFVESEAEESEEEYNDEGEVVPRVTKKFVEEEDDDEEEEEENLDDQDEQGNLKGFINDDDDEDEGEEDEGSDSGDSEDDVGHKKRKRTSFDDRLEDDDFDLIEENLGVKVKRGQKYRRVKKMSDDEDDDEEEYGKEEHEKEAIAEEIFQDGEGEEGQEAMEAPMAPPEEEEEDDEESDIDDFIVDDDGQPLKKPKWRKKLPGYTDAALQEAQEIFGVDFDYDEFEKYNEYDEELEEEYEYEDDEAEGEIRVRPKKTTKKRVSRRSIFEMYEPSELESSHLTDQDNEIRATDLPERFQLRSIPVKGAEDDELEEEADWIYRNAFATPTISLQESCDYLDRGQPASSFSRKGPSTIQKIKEALGFMRNQHFEVPFIAFYRKEYVEPELHINDLWRVWQWDEKWTQLRIRKENLTRLFEKMQAYQYEQISADPDKPLADGIRALDTTDMERLKDVQSMDELKDVYNHFLLYYGRDIPKMQNAAKASRKKLKRVREEGDEEGEGDEAEDEEQRGPELKQASRRDMYTICQSAGLDGLAKKFGLTPEQFGENLRDSYQRHETEQFPAEPLELAKDYVCSQFPTPEAVLEGARYMVALQIAREPLVRQVLRQTFQERAKLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 65880 - protein, 786 aa, Homo sapiens
MSFSRALLWARLPAGRQAGHRAAICSALRPHFGPFPGVLGQVSVLATASSSASGGSKIPNTSLFVPLTVKPQGPSADGDVGAELTRPLDKNEVKKVLDKFYKRKEIQKLGADYGLDARLFHQAFISFRNYIMQSHSLDVDIHIVLNDICFGAAHADDLFPFFLRHAKQIFPVLDCKDDLRKISDLRIPPNWYPDARAMQRKIIFHSGPTNSGKTYHAIQKYFSAKSGVYCGPLKLLAHEIFEKSNAAGVPCDLVTGEERVTVQPNGKQASHVSCTVEMCSVTTPYEVAVIDEIQMIRDPARGWAWTRALLGLCAEEVHLCGEPAAIDLVMELMYTTGEEVEVRDYKRLTPISVLDHALESLDNLRPGDCIVCFSKNDIYSVSRQIEIRGLESAVIYGSLPPGTKLAQAKKFNDPNDPCKILVATDAIGMGLNLSIRRIIFYSLIKPSINEKGERELEPITTSQALQIAGRAGRFSSRFKEGEVTTMNHEDLSLLKEILKRPVDPIRAAGLHPTAEQIEMFAYHLPDATLSNLIDIFVDFSQVDGQYFVCNMDDFKFSAELIQHIPLSLRVRYVFCTAPINKKQPFVCSSLLQFARQYSRNEPLTFAWLRRYIKWPLLPPKNIKDLMDLEAVHDVLDLYLWLSYRFMDMFPDASLIRDLQKELDGIIQDGVHNITKLIKMSETHKLLNLEGFPSGSQSRLSGTLKSQARRTRGTKALGSKATEPPSPDAGELSLASRLVQQGLLTPDMLKQLEKEWMTQQTEHNKEKTESGTHPKGTRRKKKEPDSD

SEQ ID NO: 65881 - protein, 263 aa, Homo sapiens
MSFSRALLWARLPAGRQAGHRAAICSALRPHFGPFPGVLGQVSVLATASSSASGGSKIPNTSLFVPLTVKPQGPSADGDVGAELTRPLDKNEVAVIDEIQMIRDPARGWAWTRALLGLCAEEVHLCGEPAAIDLVMELMYTTGEEVEVRDYKRLTPISVLDHALESLDNLRPGDCIVCFSKNDIYSVSRQIEIRGLESAVIYGSLPPGTKLAQAKKFNDPNDPCKILVATDAIGMGLNLSIRRIIFYSLIKPSINEKGERELE

SEQ ID NO: 65882 - protein, 410 aa, Homo sapiens
MAAVGAEARGAWCVPCLVSLDTLQELCRKEKLTCKSIGITKRNLNNYEVEYLCDYKVVKDMEYYLVKWKGWPDSTNTWEPLQNLKCPLLLQQFSNDKHNYLSQVKKGKAITPKDNNKTLKPAIAEYIVKKAKQRIALQRWQDELNRRKNHKGMIFVENTVDLEGPPSDFYYINEYKPAPGISLVNEATFGCSCTDCFFQKCCPAEAGVLLAYNKNQQIKIPPGTPIYECNSRCQCGPDCPNRIVQKGTQYSLCIFRTSNGRGWGVKTLVKIKRMSFVMEYVGEVITSEEAERRGQFYDNKGITYLFDLDYESDEFTVDAARYGNVSHFVNHSCDPNLQVFNVFIDNLDTRLPRIALFSTRTINAGEELTFDYQMKGSGDISSDSIDHSPAKKRVRTVCKCGAVTCRGYLN

SEQ ID NO: 65883 - protein, 230 aa, Homo sapiens
MAAVGAEARGAWCVPCLVSLDTLQELCRKEKLTCKSIGITKRNLNNYEVEYLCDYKVVKDMEYYLVKWKGWPDSTNTWEPLQNLKCPLLLQQFSNDKHNYLSQVITSEEAERRGQFYDNKGITYLFDLDYESDEFTVDAARYGNVSHFVNHSCDPNLQVFNVFIDNLDTRLPRIALFSTRTINAGEELTFDYQMKGSGDISSDSIDHSPAKKRVRTVCKCGAVTCRGYLN

SEQ ID NO: 65884 - protein, 152 aa, Homo sapiens
MEYYLVKWKGWPDSTNTWEPLQNLKCPLLLQQFSNDKHNYLSQVITSEEAERRGQFYDNKGITYLFDLDYESDEFTVDAARYGNVSHFVNHSCDPNLQVFNVFIDNLDTRLPRIALFSTRTINAGEELTFDYQMKGSGDISSDSIDHSPAKK

SEQ ID NO: 65885 - protein, 350 aa, Homo sapiens
MEYYLVKWKGWPDSTNTWEPLQNLKCPLLLQQFSNDKHNYLSQVKKGKAITPKDNNKTLKPAIAEYIVKKAKQRIALQRWQDELNRRKNHKGMIFVENTVDLEGPPSDFYYINEYKPAPGISLVNEATFGCSCTDCFFQKCCPAEAGVLLAYNKNQQIKIPPGTPIYECNSRCQCGPDCPNRIVQKGTQYSLCIFRTSNGRGWGVKTLVKIKRMSFVMEYVGEVITSEEAERRGQFYDNKGITYLFDLDYESDEFTVDAARYGNVSHFVNHSCDPNLQVFNVFIDNLDTRLPRIALFSTRTINAGEELTFDYQMKGSGDISSDSIDHSPAKKRVRTVCKCGAVTCRGYLN

SEQ ID NO: 65886 - protein, 885 aa, Homo sapiens
MKWLGESKIMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDCRPNCKFVSTGRDTACVKALRDIEPGEEISCYYGDGFFGENNEFCECYTCERRGTGAFKSRVGLPAPAPVINSKYGLRETDKRLNRLKKLGDSSKNSDSQSVSSNTDADTTQEKNNATSNRKSSVGVKKNSKSRTLTRQSMSRIPASSNSTSSKLTHINNSRVPKKLKKPAKPLLSKIKLRNHCKRLEQKNASRKLEMGNLVLKEPKVVLYKNLPIKKDKEPEGPAQAAVASGCLTRHAAREHRQNPVRGAHSQGESSPCTYITRRSVRTRTNLKEASDIKLEPNTLNGYKSSVTEPCPDSGEQLQPAPVLQEEELAHETAQKGEAKCHKSDTGMSKKKSRQGKLVKQFAKIEESTPVHDSPGKDDAVPDLMGPHSDQGEHSGTVGVPVSYTDCAPSPVGCSVVTSDSFKTKDSFRTAKSKKKRRITRYDAQLILENNSGIPKLTLRRRHDSSSKTNDQENDGMNSSKISIKLSKDHDNDNNLYVAKLNNGFNSGSGSSSTKLKIQLKRDEENRGSYTEGLHENGVCCSDPLSLLESRMEVDDYSQYEEESTDDSSSSEGDEEEDDYDDDFEDDFIPLPPAKRLRLIVGKDSIDIDISSRRREDQSLRLNA

SEQ ID NO: 65887 - protein, 393 aa, Homo sapiens
MKWLGESKIMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDCRPNCKFVSTGRDTACVKALRDIEPGEEISCYYGDGFFGENNEFCECYTCERRGTGAFKSRVGLPAPAPVINSKYGLRETDKRLNRLKKLGDSSKNSDSQSVSSNTDADTTQEKNNASK

SEQ ID NO: 65888 - protein, 393 aa, Homo sapiens; identical to SEQ ID NO: 65887

SEQ ID NO: 65889 - protein, 118 aa, Homo sapiens
MKWLGESKIMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDS

SEQ ID NO: 65890 - protein, 462 aa, Homo sapiens
MGPDRVTARELCENDDLATSLVLDPYLGFRTHKMNVSPVPPLRRQQHLRSALETFLRQRDLEAAYRALTLGGWTARYFQSRGPRQEAALKTHVYRYLRAFLPESGFTILPCTRYSMETNGAKIVSTRAWKKNEKLELLVGCIAELREADEGLLRAGENDFSIMYSTRKRSAQLWLGPAAFINHDCKPNCKFVPADGNAACVKVLRDIEPGDEVTCFYGEGFFGEKNEHCECHTCERKGEGAFRTRPREPALPPRPLDKYQLRETKRRLQQGLDSGSRQGLLGPRACVHPSPLRRDPFCAACQPLRLPACSARPDTSPLWLQWLPQPQPRVRPRKRRRPRPRRAPVLSTHHAARVSLHRWGGCGPHCRLRGEALVALGQPPHARWAPQQDWHWARRYGLPYVVRVDLRRLAPAPPATPAPAGTPGPILIPKQALAFAPFSPPKRLRLVVSHGSIDLDVGGEEL

SEQ ID NO: 65891 - protein, 129 aa, Homo sapiens
MPRRGRWLSCSPEAEGIRRVGSRAALRVHPLEHRPRWGTPGGMTKGSRFLAPESELSWGPGDATPGLWFFISDGVGEDLWNSAGWSSVPEGFGQRMRGPGLTPHTDAGGDGNKRRHSERLCRASVLQPP

SEQ ID NO: 65892 - protein, 247 aa, Homo sapiens
MHLARLVGSCSLLLLLGALSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQAGKEADKAVQGFHTGVHQAGKEAEKLGQGVNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 65893 - protein, 590 aa, Homo sapiens
MHLARLVGSCSLLLLLGALSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQVGKEADKLIHHGVHHGANQAGSEAGKFGQGVDNAAGQAGNEAGRFGQGVHHAAGQAGNEAGRFGQGVHHAAGQAGNEAGRFGQGAHHGLSEGWKETEKFGQGIHHAAGQVGKEAEKFGQGAHHAAGQAGNEAGRFGQGVHHGLSEGWKETEKFGQGVHHTAGQVGKEAEKFGQGAHHAAGQAGNEAGRFGQGAHHAAGQAGNEAGRFGQGVHHGLSEGWKETEKFGQGVHHAASQFGKETEKLGHGVHHGVNEAWKEAEKFGQGVHHAASQVGKEEDRVVQGLHHGVSQAGREAGQFGHDIHHTAGQAGKEGDIAVHGVQPGVHEAGKEAGQFGQGVHHTLEQAGKEADKAVQGFHTGVHQAGKEAEKLGQGVNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 65894 - protein, 95 aa, Homo sapiens
MGSHTGKELDKGVQGLNHGMDKVAHEINHGIGQAGKEAEKLGHGVNNAAGQGNHQSGSSSHQGGATTTPLASGASVNTPFINLPALWRSVANIMP

SEQ ID NO: 65895 - protein, 245 aa, Homo sapiens
MWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTI

SEQ ID NO: 65896 - protein, 189 aa, Homo sapiens
MGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 65897 - protein, 248 aa, Homo sapiens
MWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 65898 - protein, 248 aa, Homo sapiens; identical to SEQ ID NO: 65897

SEQ ID NO: 65899 - protein, 263 aa, Homo sapiens
MRPCQVPGAATGPRAMWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 65900 - protein, 248 aa, Homo sapiens; identical to SEQ ID NO: 65897

SEQ ID NO: 65901 - protein, 158 aa, Homo sapiens
MWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARA

SEQ ID NO: 65902 - protein, 158 aa, Homo sapiens; identical to SEQ ID NO: 65901

SEQ ID NO: 65903 - protein, 248 aa, Homo sapiens
MWLCPLALTLILMAASGAACEVKDVCVGSPGIPGTPGSHGLPGRDGRDGVKGDPGPPGPMGPPGETPCPPGNNGLPGAPGVPGERGEKGEAGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 65904 - protein, 248 aa, Homo sapiens; identical to SEQ ID NO: 65903

SEQ ID NO: 65905 - protein, 158 aa, Homo sapiens
MWLCPLALTLILMAASGAACEVKDVCVGSPGIPGTPGSHGLPGRDGRDGVKGDPGPPGPMGPPGETPCPPGNNGLPGAPGVPGERGEKGEAGERGPPGLPAHLDEELQATLHDFRHQILQTRGALSLQGSIMTVGEKVFSSNGQSITFDAIQEACARA

SEQ ID NO: 65906 - protein, 214 aa, Homo sapiens
MRPCQVPGAATGPRAMWLCPLALTLILMAASGAACEVKDVCVGSPGIPGKRGEKGEAGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 65907 - protein, 381 aa, Homo sapiens
MAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 65908 - protein, 375 aa, Homo sapiens
MLLFLLSALVLLTQPLGYLEAEMKTYSHRTMPSACTLVMCSSVESGLPGRDGRDGREGPRGEKGDPGLPGAAGQAGMPGQAGPVGPKGDNGSVGEPGPKGDTGPSGPPGPPGVPGPAGREGPLGKQGNIGPQGKPGPKGEAGPKGEVGAPGMQGSAGARGLAGPKGERGVPGERGVPGNTGAAGSAGAMGPQGSPGARGPPGLKGDKGIPGDKGAKGESGLPDVASLRQQVEALQGQVQHLQAAFSQYKKVELFPNGQSVGEKIFKTAGFVKPFTEAQLLCTQAGGQLASPRSAAENAALQQLVVAKNEAAFLSMTDSKTEGKFTYPTGESLVYSNWAPGEPNDDGGSEDCVEIFTNGKWNDRACGEKRLVVCEF

SEQ ID NO: 65909 - protein, 218 aa, Homo sapiens
MFLSTSKHGRQEAMLLFLLSALVLLTQPLGYLEAEMKTYSHRTMPSACTLVMCSSVESGLPGRDGRDGREGPRGEKGDPGLPGAAGQAGMPGQAGPVGPKGDNGSVGEPGPKGDTGPSGPPGPPGVPGPAGREGPLGKQGNIGPQGKPGPKGEAGPKGEVGAPGMQGSAGARGLAGPKGERGVPGERGVPGNTGAAGSAGAMGPQGSPGARGPPGLKG

SEQ ID NO: 65910 - protein, 300 aa, Homo sapiens
MAAVAALQLGLRAAGLGRAPASAAWRSVLRVSPRPGVAWRPSRCGSSAAEASATKAEDDSFLQWVLLLIPVTAFGLGTWQVQRRKWKLNLIAELESRVLAEPVPLPADPMELKNLEYRPVKVRGCFDHSKELYMMPRTMVDPVREAREGGLISSSTQSGAYVVTPFHCTDLGVTILVNRGFVPRKKVNPETRQKGQIEGEVDLIGMVRLTETRQPFVPENNPERNHWHYRDLEAMARITGAEPIFIDANFQSTVPGGPIGGQTRVTLRNEHLQYIVTWYGLSAATSYLWFKKFLRGTPGV

SEQ ID NO: 65911 - protein, 270 aa, Homo sapiens
APASAAWRSVLRVSPRPGVAWRPSRCGSSAAEASATKAEDDSFLQWVLLLIPVTAFGLGTWQVQRRKWKLNLIAELESRVLAEPVPLPADPMELKNLEYRPVKVRGCFDHSKELYMMPRTMVDPVREAREGGLISSSTQSGAYVVTPFHCTDLGKKVNPETRQKGQIEGEVDLIGMVRLTETRQPFVPENNPERNHWHYRDLEAMARITGAEPIFIDANFQSTVPGGPIGGQTRVTLRNEHLQYIVTWYGLSAATSYLWFKKFLRGTPGV

SEQ ID NO: 65912 - protein, 256 aa, Homo sapiens
MSELPGDVRAFLREHPSLRLQTDARKVRCILTGHELPCRLPELQVYTRGKKYQRLVRASPAFDYAEFEPHIVPSTKNPHQLFCKLTLRHINKCPEHVLRHTQGRRYQRALCKYEECQKQGVEYVPACLVHRRRRREDQMDGDGPRPREAFWEPTSSDEGGAASDDSMTDLYPPELFTRKDLGSTEDGDGTDDFLTDKEDEKAKPPREKATDESRRETTVYRGLVQKRGKKQLGSLKKKFKSHHRKPKSFSSCKQPG

SEQ ID NO: 65913 - protein, 269 aa, Homo sapiens
MGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 65914 - protein, 186 aa, Homo sapiens
MGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSQPSQQ

SEQ ID NO: 65915 - protein, 188 aa, Homo sapiens [sequence omitted]

SEQ ID NO: 65916 - protein, 260 aa, Homo sapiens
MRSLATEFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 65917 - protein, 128 aa, Homo sapiens
MGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRLSRTSWAQL

SEQ ID NO: 65918 - protein, 361 aa, Homo sapiens
MASLLAKDAYLQSLAKKICSHSAPEQQARTRAGKTQGSETAGPPKKKRKKTQKKFRKREEKAAEHKAKSLGEKSPAASGARRPEAAKEEAAWASSSAGNPADGLATEPESVFALDVLRQRLHEKIQEARGQGSAKELSPAALEKRRRRKQERDRKKRKRKELRAKEKARKAEEATEAQEVVEATPEGACTEPREPPGLIFNKVEVSEDEPASKAQRRKEKRQRVKGNLTPLTGRNYRQLLERLQARQSRLDELRGQDEGKAQELEAKMKWTNLLYKAEGVKIRDDERLLQEALKRKEKRRAQRQRRWEKRTAGVVEKMQQRQDRRRQNLRRKKAARAERRLLRARKKGRILPQDLERAGLV

SEQ ID NO: 65919 - protein, 262 aa, Homo sapiens
MAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKIIPPPPPICPDSLDDADALGSMLISWYMSGYHTGYYMGFRQNQKEGRCSHSLN

SEQ ID NO: 65920 - protein, 294 aa, Homo sapiens
MAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMGFRQNQKEGRCSHSLN

SEQ ID NO: 65921 - protein, 262 aa, Homo sapiens; identical to SEQ ID NO: 65919

SEQ ID NO: 65922 - protein, 282 aa, Homo sapiens
MAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMEMLA

SEQ ID NO: 65923 - protein, 294 aa, Homo sapiens
MAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMTGFHCVSQDGLNLLTP

SEQ ID NO: 65924 - protein, 227 aa, Homo sapiens
MAMSSGGSGGGVPEQEDSVLFRRGTGQSDDSDIWDDTALIKAYDKAVASFKHALKNGDICETSGKPKTTPKRKPAKKNKSQKKNTAASLQQNENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMGFRQNQKEGRCSHSLN

SEQ ID NO: 65925 - protein, 282 aa, Homo sapiens; identical to SEQ ID NO: 65922

SEQ ID NO: 65926 - protein, 262 aa, Homo sapiens; identical to SEQ ID NO: 65919

SEQ ID NO: 65927 - protein, 294 aa, Homo sapiens; identical to SEQ ID NO: 65920

SEQ ID NO: 65928 - protein, 294 aa, Homo sapiens; identical to SEQ ID NO: 65923

SEQ ID NO: 65929 - protein, 227 aa, Homo sapiens; identical to SEQ ID NO: 65924

SEQ ID NO: 65930 - protein, 1497 aa, Homo sapiens
MPRCIAHFCEKPPSVSYSILESVSKAKFAAGSVVSFKCMEGFVLNTSAKIECMRGGQWNPSPMSIQCIPVRCGEPPSIMNGYASGSNYSFGAMVAYSCNKGFYIKGEKKSTCEATGQWSSPIPTCHPVSCGEPPKVENGFLEHTTGRIFESEVRYQCNPGYKSVGSPVFVCQANRHWHSESPLMCVPLDCGKPPPIQNGFMKGENFEVGSKVQFFCNEGYELVGDSSWTCQKSGKWNKKSNPKCMPAKCPEPPLLENQLVLKELTTEVGVVTFSCKEGHVLQGPSVLKCLPSQQWNDSFPVCKIVLCTPPPLISFGVPIPSSALHFGSTVKYSCVGGFFLRGNSTTLCQPDGTWSSPLPECVPVECPQPEEIPNGIIDVQGLAYLSTALYTCKPGFELVGNTTTLCGENGHWLGGKPTCKAIECLKPKEILNGKFSYTDLHYGQTVTYSCNRGFRLEGPSALTCLETGDWDVDAPSCNAIHCDSPQPIENGFVEGADYSYGAIIIYSCFPGFQVAGHAMQTCEESGWSSSIPTCMPIDCGLPPHIDFGDCTKLKDDQGYFEQEDDMMEVPYVTPHPPYHLGAVAKTWENTKESPATHSSNFLYGTMVSYTCNPGYELLGNPVLICQEDGTWNGSAPSCISIECDLPTAPENGFLRFTETSMGSAVQYSCKPGHILAGSDLRLCLENRKWSGASPRCEAISCKKPNPVMNGSIKGSNYTYLSTLYYECDPGYVLNGTERRTCQDDKNWDEDEPICIPVDCSSPPVSANGQVRGDEYTFQKEIEYTCNEGFLLEGARSRVCLANGSWSGATPDCVPVRCATPPQLANGVTEGLDYGFMKEVTFHCHEGYILHGAPKLTCQSDGNWDAEIPLCKPVNCGPPEDLAHGFPNGFSFIHGGHIQYQCFPGYKLHGNSSRRCLSNGSWSGSSPSCLPCRCSTPVIEYGTVNGTDFDCGKAARIQCFKGFKLLGLSEITCEADGQWSSGFPHCEHTSCGSLPMIPNAFISETSSWKENVITYSCRSGYVIQGSSDLICTEKGVWSQPYPVCEPLSCGSPPSVANAVATGEAHTYESEVKLRCLEGYTMDTDTDTFTCQKDGRWFPERISCSPKKCPLPENITHILVHGDDFSVNRQVSVSCAEGYTFEGVNISVCQLDGTWEPPFSDESCSPVSCGKPESPEHGFVVGSKYTFESTIIYQCEPGYELEGNRERVCQENRQWSGGVAICKETRCETPLEFLNGKADIENRTTGPNVVYSCNRGYSLEGPSEAHCTENGTWSHPVPLCKPNPCPVPFVIPENALLSEKEFYVDQNVSIKCREGFLLQGHGIITCNPDETWTQTSAKCEKISCGPPAHVENAIARGVHYQYGDMITYSCYSGYMLEGFLRSVCLENGTWTSPPICRAVCRFPCQNGGICQRPNACSCPEGWMGRLCEEPICILPCLNGGRCVAPYQCDCPPGWTGSRCHTAVCQSPCLNGGKCVRPNRCHCLSSWTGHNCSRKRRTGF

SEQ ID NO: 65931 - protein, 1549 aa, Homo sapiens
MWPRLAFCCWGLALVSGWATFQQMSPSRNFSFRLFPETAPGAPGSIPAPPAPGDEAAGSRVERLGQAFRRRVRLLRELSERLELVFLVDDSSSVGEVNFRSELMFVRKLLSDFPVVPTATRVAIVTFSSKNYVVPRVDYISTRRARQHKCALLLQEIPAISYRGGGTYTKGAFQQAAQILLHARENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGPGGWGAANRLDYSYDDFLDTVQETATSIGNAKSSRIKRSAPLSDYKIKLIFNITASVPLPDERNDTLEWENQQRLLQTLETITNKLKRTLNKDPMYSFQLASEILIADSNSLETKKASPFCRPGSVLRGRMCVNCPLGTYYNLEHFTCESCRIGSYQDEEGQLECKLCPSGMYTEYIHSRNISDCKAQCKQGTYSYSGLETCESCPLGTYQPKFGSRSCLSCPENTSTVKRGAVNISACGVPCPEGKFSRSGLMPCHPCPRDYYQPNAGKAFCLACPFYGTTPFAGSRSITECSSFSSTFSAAEESVVPPASLGHIKKRHEISSRVFHECFFNPCHNSGTCQQLGRGYVCLCPLGYTGLKCETDIDECSPLPCLNNGVCKDLVGEFICECPSGYTGQRCEENINECSSSPCLNKGICVDGVAGYRCTCVKGFVGLHCETEVNECQSNPCLNNAVCEDQVGGFLCKCPPGFLGTRCGKNVDECLSQPCKNGATCKDGANSFRCLCAAGFTGSHCELNINECQSNPCRNQATCVDELNSYSCKCQPGFSGKRCETEQSTGFNLDFEVSGIYGYVMLDGMLPSLHALTCTFWMKSSDDMNYGTPISYAVDNGSDNTLLLTDYNGWVLYVNGREKITNCPSVNDGRWHHIAITWTSANGIWKVYIDGKLSDGGAGLSVGLPIPGMF

SEQ ID NO: 65932 - protein, 845 aa, Homo sapiens
MSPSRNFSFRLFPETAPGAPGSIPAPPAPGDEAAGSRVERLGQAFRRRVRLLRELSERLELVFLVDDSSSVGEVNFRSELMFVRKLLSDFPVVPTATRVAIVTFSSKNYVVPRVDYISTRRARQHKCALLLQEIPAISYRGGGTYTKGAFQQAAQILLHARENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGN

SEQ ID NO: 65933 - protein, 515 aa, Homo sapiens
LENQLVLKELTTEVGVVTFSCKEGHVLQGPSVLKCLPSQQWNDSFPVCKIVLCTPPPLISFGVPIPSSALHFGSTVKYSCVGGFFLRGNSTTLCQPDGTWSSPLPECVPVECPQPEEIPNGIIDVQGLAYLSTALYTCKPGFELVGNTTTLCGENGHWLGGKPTCKAIECLKPKEILNGKFSYTDLHYGQTVTYSCNRGFRLEGPSALTCLETGDWDVDAPSCNAIHCDSPQPIENGFVEGADYSYGAIIIYSCFPGFQVAGHAMQTCEESGWSSSIPTCMPIDCGLPPHIDFGDCTKLKDDQGYFEQEDDMMEVPYVTPHPPYHLGAVAKTWENTKESPATHSSNFLYGTMVSYTCNPGYELLGNPVLICQEDGTWNGSAPSCISIECDLPTAPENGFLRFTETSMGSAVQYSCKPGHILAGSDLRLCLENRKWSGASPRCEAISCKKPNPVMNGSIKGSNYTYLSTLYYECDPGYVLNGTERRTCQDDKTGMRMSPFAFLWTAVHPQSQPMAR

SEQ ID NO: 65934 - protein, 3548 aa, Homo sapiens
MSPSRNFSFRLFPETAPGAPGSIPAPPAPGDEAAGSRVERLGQAFRRRVRLLRELSERLELVFLVDDSSSVGEVNFRSELMFVRKLLSDFPVVPTATRVAIVTFSSKNYVVPRVDYISTRRARQHKCALLLQEIPAISYRGGGTYTKGAFQQAAQILLHARENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGPGGWGAANRLDYSYDDFLDTVQETATSIGNAKSSRIKRSAPLSDYKIKLIFNITASVPLPDERNDTLEWENQQRLLQTLETITNKLKRTLNKDPMYSFQLASEILIADSNSLETKKASPFCRPGSVLRGRMCVNCPLGTYYNLEHFTCESCRIGSYQDEEGQLECKLCPSGMYTEYIHSRNISDCKAQCKQGTYSYSGLETCESCPLGTYQPKFGSRSCLSCPENTSTVKRGAVNISACGVPCPEGKFSRSGLMPCHPCPRDYYQPNAGKAFCLACPFYGTTPFAGSRSITECSSFSSTFSAAEESVVPPASLGHIKKRHEISSQVFHECFFNPCHNSGTCQQLGRGYVCLCPLGYTGLKCETDIDECSPLPCLNNGVCKDLVGEFICECPSGYTGQRCEENINECSSSPCLNKGICVDGVAGYRCTCVKGFVGLHCETEVNECQSNPCLNNAVCEDQVGGFLCKCPPGFLGTRCGKNVDECLSQPCKNGATCKDGANSFRCLCAAGFTGSHCELNINECQSNPCRNQATCVDELNSYSCKCQPGFSGKRCETEQSTGFNLDFEVSGIYGYVMLDGMLPSLHALTCTFWMKSSDDMNYGTPISYAVDNGSDNTLLLTDYNGWVLYVNGREKITNCPSVNDGRWHHIAITWTSANGIWKVYIDGKLSDGGAGLSVGLPIPGGGALVLGQEQDKKGEGFSPAESFVGSISQLNLWDYVLSPQQVKSLATSCPEELSKGNVLAWPDFLSGIVGKVKIDSKSIFCSDCPRLGGSVPHLRTASEDLKPGSKVNLFCDPGFQLVGNPVQYCLNQGQWTQPLPHCERISCGVPPPLENGFHSADDFYAGSTVTYQCNNGYYLLGDSRMFCTDNGSWNGVSPSCLDVDECAVGSDCSEHASCLNVDGSYICSCVPPYTGDGKNCAEPIKCKAPGNPENGHSSGEIYTVGAEVTFSCQEGYQLMGVTKITCLESGEWNHLIPYCKAVSCGKPAIPENGCIEELAFTFGSKVTYRCNKGYTLAGDKESSCLANSSWSHSPPVCEPVKCSSPENINNGKYILSGLTYLSTASYSCDTGYSLQGPSIIECTASGIWDRAPPACHLVFCGEPPAIKDAVITGNNFTFRNTVTYTCKEGYTLAGLDTIECLADGKWSRSDQQCLAVSCDEPPIVDHASPETAHRLFGDIAFYYCSDGYSLADNSQLLCNAQGKWVPPEGQDMPRCIAHFCEKPPSVSYSILESVSKAKFAAGSVVSFKCMEGFVLNTSAKIECMRGGQWNPSPMSIQCIPVRCGEPPSIMNGYASGSNYSFGAMVAYSCNKGFYIKGEKKSTCEATGQWSSPIPTCHPVSCGEPPKVENGFLEHTTGRIFESEVRYQCNPGYKSVGSPVFVCQANRHWHSESPLMCVPLDCGKPPPIQNGFMKGENFEVGSKVQFFCNEGYELVGDSSWTCQKSGKWNKKSNPKCMPAKCPEPPLLENQLVLKELTTEVGVVTFSCKEGHVLQGPSVLKCLPSQQWNDSFPVCKIVLCTPPPLISFGVPIPSSALHFGSTVKYSCVGGFFLRGNSTTLCQPDGTWSSPLPECVPVECPQPEEIPNGIIDVQGLAYLSTALYTCKPGFELVGNTTTLCGENGHWLGGKPTCKAIECLKPKEILNGKFSYTDLHYGQTVTYSCNRGFRLEGPSALTCLETGDWDVDAPSCNAIHCDSPQPIENGFVEGADYSYGAIIIYSCFPGFQVAGHAMQTCEESGWSSSIPTCMPIDCGLPPHIDFGDCTKLKDDQGYFEQEDDMMEVPYVTPHPPYHLGAVAKTWENTKESPATHSSNFLYGTMVSYTCNPGYELLGNPVLICQEDGTWNGSAPSCISIECDLPTAPENGFLRFTETSMGSAVQYSCKPGHILAGSDLRLCLENRKWSGASPRCEAISCKKPNPVMNGSIKGSNYTYLSTLYYECDPGYVLNGTERRTCQDDKNWDEDEPICIPVDCSSPPVSANGQVRGDEYTFQKEIEYTCNEGFLLEGARSRVCLANGSWSGATPDCVPVRCATPPQLANGVTEGLDYGFMKEVTFHCHEGYILHGAPKLTCQSDGNWDAEIPLCKPVNCGPPEDLAHGFPNGFSFIHGGHIQYQCFPGYKLHGNSSRRCLSNGSWSGSSPSCLPCRCSTPVIEYGTVNGTDFDCGKAARIQCFKGFKLLGLSEITCEADGQWSSGFPHCEHTSCGSLPMIPNAFISETSSWKENVITYSCRSGYVIQGSSDLICTEKGVWSQPYPVCEPLSCGSPPSVANAVATGEAHTYESEVKLRCLEGYTMDTDTDTFTCQKDGRWFPERISCSPKKCPLPENITHILVHGDDFSVNRQVSVSCAEGYTFEGVNISVCQLDGTWEPPFSDESCSPVSCGKPESPEHGFVVGSKYTFESTIIYQCEPGYELEGNRERVCQENRQWSGGVAICKETRCETPLEFLNGKADIENRTTGPNVVYSCNRGYSLEGPSEAHCTENGTWSHPVPLCKPNPCPVPFVIPENALLSEKEFYVDQNVSIKCREGFLLQGHGIITCNPDETWTQTSAKCEKISCGPPAHVENAIARGVHYQYGDMITYSCYSGYMLEGFLRSVCLENGTWTSPPICRAVCRFPCQNGGICQRPNACSCPEGWMGRLCEEPICILPCLNGGRCVAPYQCDCPPGWTGSRCHTAVCQSPCLNGGKCVRPNRCHCLSSWTGHNCSRKRRTGF

SEQ ID NO: 65935 - protein, 3571 aa, Homo sapiens
MWPRLAFCCWGLALVSGWATFQQMSPSRNFSFRLFPETAPGAPGSIPAPPAPGDEAAGSRVERLGQAFRRRVRLLRELSERLELVFLVDDSSSVGEVNFRSELMFVRKLLSDFPVVPTATRVAIVTFSSKNYVVPRVDYISTRRARQHKCALLLQEIPAISYRGGGTYTKGAFQQAAQILLHARENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGPGGWGAANRLDYSYDDFLDTVQETATSIGNAKSSRIKRSAPLSDYKIKLIFNITASVPLPDERNDTLEWENQQRLLQTLETITNKLKRTLNKDPMYSFQLASEILIADSNSLETKKASPFCRPGSVLRGRMCVNCPLGTYYNLEHFTCESCRIGSYQDEEGQLECKLCPSGMYTEYIHSRNISDCKAQCKQGTYSYSGLETCESCPLGTYQPKFGSRSCLSCPENTSTVKRGAVNISACGVPCPEGKFSRSGLMPCHPCPRDYYQPNAGKAFCLACPFYGTTPFAGSRSITECSSFSSTFSAAEESVVPPASLGHIKKRHEISSQVFHECFFNPCHNSGTCQQLGRGYVCLCPLGYTGLKCETDIDECSPLPCLNNGVCKDLVGEFICECPSGYTGQRCEENINECSSSPCLNKGICVDGVAGYRCTCVKGFVGLHCETEVNECQSNPCLNNAVCEDQVGGFLCKCPPGFLGTRCGKNVDECLSQPCKNGATCKDGANSFRCLCAAGFTGSHCELNINECQSNPCRNQATCVDELNSYSCKCQPGFSGKRCETEQSTGFNLDFEVSGIYGYVMLDGMLPSLHALTCTFWMKSSDDMNYGTPISYAVDNGSDNTLLLTDYNGWVLYVNGREKITNCPSVNDGRWHHIAITWTSANGIWKVYIDGKLSDGGAGLSVGLPIPGGGALVLGQEQDKKGEGFSPAESFVGSISQLNLWDYVLSPQQVKSLATSCPEELSKGNVLAWPDFLSGIVGKVKIDSKSIFCSDCPRLGGSVPHLRTASEDLKPGSKVNLFCDPGFQLVGNPVQYCLNQGQWTQPLPHCERISCGVPPPLENGFHSADDFYAGSTVTYQCNNGYYLLGDSRMFCTDNGSWNGVSPSCLDVDECAVGSDCSEHASCLNVDGSYICSCVPPYTGDGKNCAEPIKCKAPGNPENGHSSGEIYTVGAEVTFSCQEGYQLMGVTKITCLESGEWNHLIPYCKAVSCGKPAIPENGCIEELAFTFGSKVTYRCNKGYTLAGDKESSCLANSSWSHSPPVCEPVKCSSPENINNGKYILSGLTYLSTASYSCDTGYSLQGPSIIECTASGIWDRAPPACHLVFCGEPPAIKDAVITGNNFTFRNTVTYTCKEGYTLAGLDTIECLADGKWSRSDQQCLAVSCDEPPIVDHASPETAHRLFGDIAFYYCSDGYSLADNSQLLCNAQGKWVPPEGQDMPRCIAHFCEKPPSVSYSILESVSKAKFAAGSVVSFKCMEGFVLNTSAKIECMRGGQWNPSPMSIQCIPVRCGEPPSIMNGYASGSNYSFGAMVAYSCNKGFYIKGEKKSTCEATGQWSSPIPTCHPVSCGEPPKVENGFLEHTTGRIFESEVRYQCNPGYKSVGSPVFVCQANRHWHSESPLMCVPLDCGKPPPIQNGFMKGENFEVGSKVQFFCNEGYELVGDSSWTCQKSGKWNKKSNPKCMPAKCPEPPLLENQLVLKELTTEVGVVTFSCKEGHVLQGPSVLKCLPSQQWNDSFPVCKIVLCTPPPLISFGVPIPSSALHFGSTVKYSCVGGFFLRGNSTTLCQPDGTWSSPLPECVPVECPQPEEIPNGIIDVQGLAYLSTALYTCKPGFELVGNTTTLCGENGHWLGGKPTCKAIECLKPKEILNGKFSYTDLHYGQTVTYSCNRGFRLEGPSALTCLETGDWDVDAPSCNAIHCDSPQPIENGFVEGADYSYGAIIIYSCFPGFQVAGHAMQTCEESGWSSSIPTCMPIDCGLPPHIDFGDCTKLKDDQGYFEQEDDMMEVPYVTPHPPYHLGAVAKTWENTKESPATHSSNFLYGTMVSYTCNPGYELLGNPVLICQEDGTWNGSAPSCISIECDLPTAPENGFLRFTETSMGSAVQYSCKPGHILAGSDLRLCLENRKWSGASPRCEAISCKKPNPVMNGSIKGSNYTYLSTLYYECDPGYVLNGTERRTCQDDKNWDEDEPICIPVDCSSPPVSANGQVRGDEYTFQKEIEYTCNEGFLLEGARSRVCLANGSWSGATPDCVPVRCATPPQLANGVTEGLDYGFMKEVTFHCHEGYILHGAPKLTCQSDGNWDAEIPLCKPVNCGPPEDLAHGFPNGFSFIHGGHIQYQCFPGYKLHGNSSRRCLSNGSWSGSSPSCLPCRCSTPVIEYGTVNGTDFDCGKAARIQCFKGFKLLGLSEITCEADGQWSSGFPHCEHTSCGSLPMIPNAFISETSSWKENVITYSCRSGYVIQGSSDLICTEKGVWSQPYPVCEPLSCGSPPSVANAVATGEAHTYESEVKLRCLEGYTMDTDTDTFTCQKDGRWFPERISCSPKKCPLPENITHILVHGDDFSVNRQVSVSCAEGYTFEGVNISVCQLDGTWEPPFSDESCSPVSCGKPESPEHGFVVGSKYTFESTIIYQCEPGYELEGNRERVCQENRQWSGGVAICKETRCETPLEFLNGKADIENRTTGPNVVYSCNRGYSLEGPSEAHCTENGTWSHPVPLCKPNPCPVPFVIPENALLSEKEFYVDQNVSIKCREGFLLQGHGIITCNPDETWTQTSAKCEKISCGPPAHVENAIARGVHYQYGDMITYSCYSGYMLEGFLRSVCLENGTWTSPPICRAVCRFPCQNGGICQRPNACSCPEGWMGRLCEEPICILPCLNGGRCVAPYQCDCPPGWTGSRCHTAVCQSPCLNGGKCVRPNRCHCLSSWTGHNCSRKRRTGF

SEQ ID NO: 65936 - protein, 451 aa, Homo sapiens
MDFDVGRTTHLSSSPCSASNGGESGQVSKRRCLIGESGHDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 65937 - protein, 464 aa, Homo sapiens
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 65938 - protein, 405 aa, Homo sapiens
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKHMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 65939 - protein, 379 aa, Homo sapiens
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQAVAANPTLLLQYGASG

SEQ ID NO: 65940 - protein, 444 aa, Homo sapiens
MGSPAHRPALLLLLPPLLLLLLLRVPPSRSFPDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 65941 - protein, 465 aa, Homo sapiens
MASQLTQRGALFLLFFLTPAVTPTWYAGSGYYPDESYNEVYAEEVPQAPALDYRVPRWCYTLNIQDGEATCYSPKGGNYHSSLGTRCELSCDRGFRLIGRRSVQCLPSRRWSGTAYCRQMRCHALPFITSGTYTCTNGVLLDSRCDYSCSSGYHLEGDRSRICMEDGRWSGGEPVCVDIDPPKIRCPHSREKMAEPEKLTARVYWDPPLVKDSADGTITRVTLRGPEPGSHFPEGEHVIRYTAYDRAYNRASCKFIVKVQVRRCPTLKPPQHGYLTCTSAGDNYGATCEYHCDGGYDRQGTPSRVCQSSRQWSGSPPICAPMKINVNVNSAAGLLDQFYEKQRLLIISAPDPSNRYYKMQISMLQQSTCGLDLRHVTIIELVGQPPQEVGRIREQQLSANIIEELRQFQRLTRSYFNMVLIDKQGIDRDRYMEPVTPEEIFTFIDDYLLSNQELTQRREQRDICE

SEQ ID NO: 65942 - protein, 483 aa, Homo sapiens
  MOD_RES (1)..(1): Any amino acid
XTFMVEDAVEAIGFGKFQWKLSVLTGLAWMADAMEMMILSILAPQLHCEWRLPSWQVALLTSVVFVGMMSSSTLWGNISDQYGRKTGLKISVLWTLYYGILSAFAPVYSWILVLRGLVGFGIGGVPQSVTLYAEFLPMKARAKCILLIEVFWAIGTVFEVVLAVFVMPSLGWRWLLILSAVPLLLFAVLCFWLPESARYDVLSGNQEKAIATLKRIATENGAPMPLGKLIISRQEDRGKMRDLFTPHFRWTTLLLWFIWFSNAFSYYGLVLLTTELFQAGDVCGISSRKKAVEAKCSLACEYLSEEDYMDLLWTTLSEFPGVLVTLWIIDRLGRKKTMALCFVIFSFCSLLLFICVGRNVLTLLLFIARAFISGGFQAAYVYTPEVYPTATRALGLGTCSGMARVGALITPFIAQVMLESSVYLTLAVYSGCCLLAALASCFLPIETKGRGLQESSHREWGQEMVGRGMHGAGVTRSNSGSQE

SEQ ID NO: 65943 - protein, 12 aa, Homo sapiens
MEEDLFQLRQLP

SEQ ID NO: 65944 - protein, 340 aa, Homo sapiens
MAAGRLIIKTEFLPTKYRGYMLPLSQVFWLAGSLLIIGLASVIIPTIGWRWLIRVASIPGIILIVAFKFIPESARFNVSTGNTRAALATLERVAKMNRSVMPEGKLVEPVLEKRGRFADLLDAKYLRTTLQIWVIWLGISFAYYGVILASAELLERDLVCGSKSDSAVVVTGGDSGESQSPCYCHMFAPSDYRTMIISTIGEIALNPLNILGINFLGRRLSLSITMGCTALFFLLLNICTSSAGLIGFLFMLRALVAANFNTVYIYTAEVYPTTMRALGMGTSGSLCRIGAMVAPFISQVLMSASILGALCLFSSVCVVCAISAFTLPIETKGRALQQIK

SEQ ID NO: 65945 - protein, 492 aa, Homo sapiens
MATKPTEPVTILSLRKLSLGTAEPQVKEPKTFTVEDAVETIGFGRFHIALFLIMGSTGVVEAMEIMLIAVVSPVIRCEWQLENWQVALVTTMVFFGYMVFSILFGLLADRYGRWKILLISFLWGAYFSLLTSFAPSYIWFVFLRTMVGCGVSGHSQGLIIKTEFLPTKYRGYMLPLSQVFWLAGSLLIIGLASVIIPTIGWRWLIRVASIPGIILIVAFKFIPESARFNVSTGNTRAALATLERVAKMNRSVMPEGKLVEPVLEKRGRFADLLDAKYLRTTLQIWVIWLGISFAYYGVILASAELLERDLVCGSKSDSAVVVTGGDSGESQSPCYCHMFAPSDYRTMIISTIGEIALNPLNILGINFLGRRLSLSITMGCTALFFLLLNICTSSAGLIGFLFMLRALVAANFNTVYIYTAEVYPTTMRALGMGTSGSLCRIGAMVAPFISQVLMSASILGALCLFSSVCVVCAISAFTLPIETKGRALQQIK

SEQ ID NO: 65946 - protein, 340 aa, Homo sapiens; identical to SEQ ID NO: 65944

SEQ ID NO: 65947 - protein, 585 aa, Homo sapiens
MGSLKEELLKAIWHAFTALDQDHSGKVSKSQLKVLSHNLCTVLKVPHDPVALEEHFRDDDEGPVSNQGYMPYLNRFILEKVQDNFDKIEFNRMCWTLCVKKNLTKNPLLITEEDAFKIWVIFNFLSEDKYPLIIVSEEIEYLLKKLTEAMGGGWQQEQFEHYKINFDDSKNGLSAWELIELIGNGQFSKGMDRQTVSMAINEVFNELILDVLKQGYMMKKGHRRKNWTERWFVLKPNIISYYVSEDLKDKKGDILLDENCCVESLPDKDGKKCLFLVKCFDKTFEISASDKKKKQEWIQAIHSTIHLLKLGSPPPHKEARQRRKELRKKQLAEQEELERQMKELQAANESKQQELEAVRKKLEEAASRAAEEEKKRLQTQVELQARFSTELEREKLIRQQMEEQVAQKSSELEQYLQRVRELEDMYLKLQEALEDERQARQDEETVRKLQARLLEEESSKRAELEKWHLEQQQAIQTTEAEKQELENQRVLKEQALQEAMEQLEQLELERKQALEQYEEVKKKLEMATNKTKSWKDKVAHHEGLIRLIEPGSKNPHLITNWGPAAFTEAELEEREKNWKEKKTTE

SEQ ID NO: 65948 - protein, 1042 aa, Homo sapiens
MEQDTAAVAATVAAADATATIVVIEDEQPGPSTSQEEGAAAAATEATAATEKGEKKKEKNVSSFQLKLAAKAPKSEKEMDPEYEEKMKADRAKRFEFLLKQTELFAHFIQPSAQKSPTSPLNMKLGRPRIKKDEKQSLISAGDYRHRRTEQEEDEELLSESRKTSNVCIRFEVSPSYVKGGPLRDYQIRGLNWLISLYENGVNGILADEMGLGKTLQTIALLGYLKHYRNIPGPHMVLVPKSTLHNWMNEFKRWVPSLRVICFVGDKDARAAFIRDEMMPGEWDVCVTSYEMVIKEKSVFKKFHWRYLVIDEAHRIKNEKSKLSEIVREFKSTNRLLLTGTPLQNNLHELWALLNFLLPDVFNSADDFDSWFDTKNCLGDQKLVERLHAVLKPFLLRRIKTDVEKSLPPKKEIKIYLGLSKMQREWYTKILMKDIDVLNSSGKMDKMRLLNILMQLRKCCNHPYLFDGAEPGPPYTTDEHIVSNSGKMVVLDKLLAKLKEQGSRVLIFSQMTRLLDILEDYCMWRGYEYCRLDGQTPHEEREEAIEAFNAPNSSKFIFMLSTRAGGLGINLASADVVILYDSDWNPQVDLQAMDRAHRIGQKKPVRVFRLITDNTVEERIVERAEIKLRLDSIVIQQGRLIDQQSNKLAKEEMLQMIRHGATHVFASKESELTDEDITTILERGEKKTAEMNERLQKMGESSLRNFRMDIEQSLYKFEGEDYREKQKLGMVEWIEPPKRERKANYAVDAYFREALRVSEPKIPKAPRPPKQPNVQDFQFFPPRLFELLEKEILYYRKTIGYKVPRNPDIPNPALAQREEQKKIDGAEPLTPEETEEKEKLLTQGFTNWTKRDFNQFIKANEKYGRDDIDNIAREVEGKSPEEVMEYSAVFWERCNELQDIEKIMAQIERGEARIQRRISIKKALDAKIARYKAPFHQLRIQYGTSKGKNYTEEEDRFLICMLHKMGFDRENVYEELRQCVRNAPQFRFDWFIKSRTAMEFQRRCNTLISLIEKENMEIEERERAEKKKRATKTPMVKFSAFS

SEQ ID NO: 65949 - protein, 1054 aa, Homo sapiens
MEQDTAAVAATVAAADATATIVVIEDEQPGPSTSQEEGAAAAATEATAATEKGEKKKEKNVSSFQLKLAAKAPKSEKEMDPEYEEKMKADRAKRFEFLLKQTELFAHFIQPSAQKSPTSPLNMKLGRPRIKKDEKQSLISAGDYRHRRTEQEEDEELLSESRKTSNVCIRFEVSPSYVKGGPLRDYQIRGLNWLISLYENGVNGILADEMGLGKTLQTIALLGYLKHYRNIPGPHMVLVPKSTLHNWMNEFKRWVPSLRVICFVGDKDARAAFIRDEMMPGEWDVCVTSYEMVIKEKSVFKKFHWRYLVIDEAHRIKNEKSKLSEIVREFKSTNRLLLTGTPLQNNLHELWALLNFLLPDVFNSADDFDSWFDTKNCLGDQKLVERLHAVLKPFLLRRIKTDVEKSLPPKKEIKIYLGLSKMQREWYTKILMKDIDVLNSSGKMDKMRLLNILMQLRKCCNHPYLFDGAEPGPPYTTDEHIVSNSGKMVVLDKLLAKLKEQGSRVLIFSQMTRLLDILEDYCMWRGYEYCRLDGQTPHEEREDKFLEVEFLGQREAIEAFNAPNSSKFIFMLSTRAGGLGINLASADVVILYDSDWNPQVDLQAMDRAHRIGQKKPVRVFRLITDNTVEERIVERAEIKLRLDSIVIQQGRLIDQQSNKLAKEEMLQMIRHGATHVFASKESELTDEDITTILERGEKKTAEMNERLQKMGESSLRNFRMDIEQSLYKFEGEDYREKQKLGMVEWIEPPKRERKANYAVDAYFREALRVSEPKIPKAPRPPKQPNVQDFQFFPPRLFELLEKEILYYRKTIGYKVPRNPDIPNPALAQREEQKKIDGAEPLTPEETEEKEKLLTQGFTNWTKRDFNQFIKANEKYGRDDIDNIAREVEGKSPEEVMEYSAVFWERCNELQDIEKIMAQIERGEARIQRRISIKKALDAKIARYKAPFHQLRIQYGTSKGKNYTEEEDRFLICMLHKMGFDRENVYEELRQCVRNAPQFRFDWFIKSRTAMEFQRRCNTLISLIEKENMEIEERERAEKKKRATKTPMVKFSAFS

SEQ ID NO: 65950 - protein, 1042 aa, Homo sapiens; identical to SEQ ID NO: 65948

SEQ ID NO: 65951 - protein, 1005 aa, Homo sapiens
MEQDTAAVAATVAAADATATIVVIEDEQPGPSTSQEEKNVSSFQLKLAAKAPKSEKEMDPEYEEKMKADRAKRFEFLLKQTELFAHFIQPSAQKSPTSPLNMKLGRPRIKKDEKQSLISAGDYRHRRTEQEEDEELLSESRKTSNVCIRFEVSPSYVKGGPLRDYQIRGLNWLISLYENGVNGILADEMGLGKTLQTIALLGYLKHYRNIPGPHMVLVPKSTLHNWMNEFKRWVPSLRVICFVGDKDARAAFIRDEMMPGEWDVCVTSYEMVIKEKSVFKKFHWRYLVIDEAHRIKNEKSKLSEIVREFKSTNRLLLTGTPLQNNLHELWALLNFLLPDVFNSADDFDSWFDTKNCLGDQKLVERLHAVLKPFLLRRIKTDVEKSLPPKKEIKIYLGLSKMQREWYTKILMKDIDVLNSSGKMDKMRLLNILMQLRKCCNHPYLFDGAEPGPPYTTDEHIVSNSGKMVVLDKLLAKLKEQGSRVLIFSQMTRLLDILEDYCMWRGYEYCRLDGQTPHEEREDKFLEVEFLGQREAIEAFNAPNSSKFIFMLSTRAGGLGINLASADVVILYDSDWNPQVDLQAMDRAHRIGQKKPVRVFRLITDNTVEERIVERAEIKLRLDSIVIQQGRLIDQQSNKLAKEEMLQMIRHGATHVFASKESELTDEDITTILERGEKKTAEMNERLQKMGESSLRNFRMDIEQSLYKFEGEDYREKQKLGMVEWIEPPKRERKANYAVDAYFREALRVSEPKIPKAPRPPKQPNVQDFQFFPPRLFELLEKEILYYRKTIGYKVPRNPDIPNPALAQREEQKKIDGAEPLTPEETEEKEKLLTQGFTNWTKRDFNQFIKANEKYGRDDIDNIAREVEGKSPEEVMEYSAVFWERCNELQDIEKIMAQIERGEARIQRRISIKKALDAKIARYKAPFHQLRIQYGTSKGKNYTEEEDRFLICMLHKMGFDRENVYEELRQCVRNAPQFRFDWFIKSRTAMEFQRRCNTLISLIEKE

SEQ ID NO: 65952 - protein, 278 aa, Homo sapiens
MLMKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 65953 - protein, 236 aa, Homo sapiens
MEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 65954 - protein, 1590 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 65955 - protein, 1572 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 65956 - protein, 119 aa, Homo sapiens [sequence omitted]

SEQ ID NO: 65957 - protein, 236 aa, Homo sapiens; identical to SEQ ID NO: 65953

SEQ ID NO: 65958 - protein, 236 aa, Homo sapiens; identical to SEQ ID NO: 65953

SEQ ID NO: 65959 - protein, 254 aa, Homo sapiens
MEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 65960 - protein, 1572 aa, Homo sapiens; identical to SEQ ID NO: 65955

SEQ ID NO: 65961 - protein, 1590 aa, Homo sapiens; identical to SEQ ID NO: 65954

SEQ ID NO: 65962 - protein, 177 aa, Homo sapiens
MEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESE

SEQ ID NO: 65963 - protein, 271 aa, Homo sapiens
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDERVSVADW

SEQ ID NO: 65964 - protein, 153 aa, Homo sapiens
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDL

SEQ ID NO: 65965 - protein, 155 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGA

SEQ ID NO: 65966 - protein, 559 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKR

SEQ ID NO: 65967 - protein, 171 aa, Homo sapiens
MEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIA

SEQ ID NO: 65968 - protein, 66 aa, Homo sapiens
MSTPTDPGAMPHPGPSPGPGPSPGPILGPSPGPGPSPGSVHSMMGPSPGPPSVSHPMPTMGSTDFP

SEQ ID NO: 65969 - protein, 1647 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 65970 - protein, 1679 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKKITGKDIHDTASSVARGLQFQRGLQFCTRASKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 65971 - protein, 1617 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKTLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 65972 - protein, 1681 aa, Homo sapiens [sequence omitted]

SEQ ID NO: 65973 - protein, 1647 aa, Homo sapiens; identical to SEQ ID NO: 65969

SEQ ID NO: 65974 - protein, 1613 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 65975 - protein, 1616 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKTLKAIEEGTLEEIEEEVRQKKSSRKRKRDSDAGSSTPTTSTRSRDKDDESKKQKKRGRPPAEKLSPNPPNLTKKMKKIVDAVIKYKDSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 65976 - protein, 1614 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 65977 - protein, 1052 aa, Homo sapiens
MSSAAEPPPPPPPESAPSKPAASIASGGSNSSNKGGPEGVAAQAVASAASAGPADAEMEEIFDDASPGKQKEIQEPDPTYEEKMQTDRANRFEYLLKQTELFAHFIQPAAQKTPTSPLKMKPGRPRIKKDEKQNLLSVGDYRHRRTEQEEDEELLTESSKATNVCTRFEDSPSYVKWGKLRDYQVRGLNWLISLYENGINGILADEMGLGKTLQTISLLGYMKHYRNIPGPHMVLVPKSTLHNWMSEFKRWVPTLRSVCLIGDKEQRAAFVRDVLLPGEWDVCVTSYEMLIKEKSVFKKFNWRYLVIDEAHRIKNEKSKLSEIVREFKTTNRLLLTGTPLQNNLHELWSLLNFLLPDVFNSADDFDSWFDTNNCLGDQKLVERLHMVLRPFLLRRIKADVEKSLPPKKEVKIYVGLSKMQREWYTRILMKDIDILNSAGKMDKMRLLNILMQLRKCCNHPYLFDGAEPGPPYTTDMHLVTNSGKMVVLDKLLPKLKEQGSRVLIFSQMTRVLDILEDYCMWRNYEYCRLDGQTPHDERQDSINAYNEPNSTKFVFMLSTRAGGLGINLATADVVILYDSDWNPQVDLQAMDRAHRIGQTKTVRVFRFITDNTVEERIVERAEMKLRLDSIVIQQGRLVDQNLNKIGKDEMLQMIRHGATHVFASKESEITDEDIDGILERGAKKTAEMNEKLSKMGESSLRNFTMDTESSVYNFEGEDYREKQKIAFTEWIEPPKRERKANYAVDAYFREALRVSEPKAPKAPRPPKQPNVQDFQFFPPRLFELLEKEILFYRKTIGYKVPRNPELPNAAQAQKEEQLKIDEAESLNDEELEEKEKLLTQGFTNWNKRDFNQFIKANEKWGRDDIENIAREVEGKTPEEVIEYSAVFWERCNELQDIEKIMAQIERGEARIQRRISIKKALDTKIGRYKAPFHQLRISYGTNKGKNYTEEEDRFLICMLHKLGFDKENVYDELRQCIRNSPQFRFDWFLKSRTAMELQRRCNTLITLIERENMELEEKEKAEKKKRGPKPSTQKRKMDGAPDGRGRKKKLKL

SEQ ID NO: 65978 - protein, 995 aa, Homo sapiens [sequence omitted]

SEQ ID NO: 65979 - protein, 995 aa, Homo sapiens [sequence omitted]

SEQ ID NO: 65980 - protein, 954 aa, Homo sapiens
MSLPLTEEQRKKIEENRQKALARRAEKLLAEQHQRTSSGTSIAGNPFQAKQGPSQNFPRESCKPVSHGVIFKQQNLSSSSNADQRPHDSHSFQAKGIWKKPEEMPTACPGHSPRSQMALTGISPPLAQSPPEVPKQQLLSYELGQGHAQASPEIRFTPFANPTHKPLAKPKSSQETPAHSSGQPPRDAKLEAKTAKASPSGQNISYIHSSSESVTPRTEGRLQQKSGSSVQKGVNSQKGKCVRNGDRFQVLIGYNAELIAVFKTLPSKNYDPDTKTWNFSMNDYSALMKAAQSLPTVNLQPLEWAYGSSESPSTSSEGQAGLPSAPSLSFVKGRCMLISRAYFEADISYSQDLIALFKQMDSRRYDVKTRKWSFLLEEHSKLIAKVRCLPQVQLDPLPTTLTLAFASQLKKTSLSLTPDVPEADLSEVDPKLVSNLMPFQRAGVNFAIAKGGRLLLADDMGLGKTIQAICIAAFYRKEWPLLVVVPSSVRFTWEQAFLRWLPSLSPDCINVVVTGKDRLTAGLINIVSFDLLSKLEKQLKTPFKVVIIDESHFLKNSRTARCRAAMPVLKVAKRVILLSGTPAMSRPAELYTQIIAVKPTFFPQFHAFGLRYCDAKRMPWGWDYSGSSNLGELKLLLEEAVMLRRLKSDVLSQLPAKQRKIVVIAPGRINARTRAALDAAAKEMTTKDKTKQQQKDALILFFNRTAEAKIPSVIEYILDLLESGREKFLVFAHHKVVLDAITQELERKHVQHIRIDGSTSSAEREDLCQQFQLSERHAVAVLSITAANMGLTFSSADLVVFAELFWNPGVLIQAEDRVHRIGQTSSVGIHYLVAKGTADDYLWPLIQEKIKVLAEAGLSETNFSEMTESTDYLYKDPKQQKIYDLFQKSFEKEGSDMELLEAAESFDPGSASGTSGSSSQNMGDTLDESSLTASPQKKRRFEFFDNWDSFTSPL

SEQ ID NO: 65981 - protein, 954 aa, Homo sapiens; identical to SEQ ID NO: 65980

SEQ ID NO: 65982 - protein, 19 aa, Homo sapiens
MSLPLTEEQRKKIEENRQK

SEQ ID NO: 65983 - protein, 146 aa, Homo sapiens
MSLPLTEEQRKKIEENRQKALARRAEKLLAEQHQRTSSGTSIAGNPFQAKQGPSQNFPRESCKPVSHGVIFKQQNLSSSSNADQRPHDSHSFQAKGIWKKPEEMPTACPGHSPRSQMALTGISPPLAQSPPEVPKQQLLSYELGQG

SEQ ID NO: 65984 - protein, 92 aa, Homo sapiens
MSLPLTEEQRKKIEENRQKALARRAEKLLAEQHQRTSSGTSIAGNPFQAKQGPSQNFPRESCKPVSHGVIFKQQNLSSSSNADQRPHDSHSF

SEQ ID NO: 65985 - protein, 130 aa, Homo sapiens
MSLPLTEEQRKKIEENRQKALARRAEKLLAEQHQRTSSGTSIAGNPFQAKQGPSQNFPRESCKPVSHGVIFKQQNLSSSSNADQRPHDSHSFQAKGIWKKPEEMPTACPGHSPRSQMALTGISPPLAQSP

SEQ ID NO: 65986 - protein, 1105 aa, Homo sapiens
MAAAAGGGGPGTAVGATGSGIAAAAAGLAVYRRKDGGPATKFWESPETVSQLDSVRVWLGKHYKKYVHADAPTNKTLAGLVVQLLQFQEDAFGKHVTNPAFTKLPAKCFMDFKAGGALCHILGAAYKYKNEQGWRRFDLQNPSRMDRNVEMFMNIEKTLVQNNCLTRPNIYLIPDIDLKLANKLKDIIKRHQGTFTDEKSKASHHIYPYSSSQDDEEWLRPVMRKEKQVLVHWGFYPDSYDTWVHSNDVDAEIEDPPIPEKPWKVHVKWILDTDIFNEWMNEEDYEVDENRKPVSFRQRISTKNEEPVRSPERRDRKASANARKRKHSPSPPPPTPTESRKKSGKKGQASLYGKRRSQKEEDEQEDLTKDMEDPTPVPNIEEVVLPKNVNLKKDSENTPVKGGTVADLDEQDEETVTAGGKEDEDPAKGDQSRSVDLGEDNVTEQTNHIIIPSYASWFDYNCIHVIERRALPEFFNGKNKSKTPEIYLAYRNFMIDTYRLNPQEYLTSTACRRNLTGDVCAVMRVHAFLEQWGLVNYQVDPESRPMAMGPPPTPHFNVLADTPSGLVPLHLRSPQVPAAQQMLNFPEKNKEKPVDLQNFGLRTDIYSKKTLAKSKGASAGREWTEQETLLLLEALEMYKDDWNKVSEHVGSRTQDECILHFLRLPIEDPYLENSDASLGPLAYQPVPFSQSGNPVMSTVAFLASVVDPRVASAAAKAALEEFSRVREEVPLELVEAHVKKVQEAARASGKVDPTYGLESSCIAGTGPDEPEKLEGAEEEKMEADPDGQQPEKAENKVENETDEGDKAQDGENEKNSEKEQDSEVSEDTKSEEKETEENKELTDTCKERESDTGKKKVEHEISEGNVATAAAAALASAATKAKHLAAVEERKIKSLVALLVETQMKKLEIKLRHFEELETIMDREKEALEQQRQQLLTERQNFHMEQLKYAELRARQQMEQQQHGQNPQQAHQHSGGPGLAPLGAAGHPGMMPHQQPPPYPLMHHQMPPPHPPQPGQIPGPGSMMPGQHMPGRMIPTVAANIHPSGSGPTPPGMPPMPGNILGPRVPLTAPNGMYPPPPQQQPPPPPPADGVPPPPAPGPPASAAP

SEQ ID NO: 65987 - protein, 1214 aa, Homo sapiens
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVAGNAPLGLPFGMPPPPPPPAPSIIPFGSLADSISINLPAPPNLHGHHHHLPFAPGTLPPPNLPVSMANPLHPNLPATTTMPSSLPLGPGLGSAAAQSPAIVAAVQGNLLPSASPLPDPGTPLPPDPTAPSPGTVTPVPPPQ

SEQ ID NO: 65988 - protein, 1130 aa, Homo sapiens
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQGRQVDADTKAGRKGKELDDLVPETAKGKPELQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVADPGTPLPPDPTAPSPGTVTPVPPPQ

SEQ ID NO: 65989 - protein, 1152 aa, Homo sapiens
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQGRQVDADTKAGRKGKELDDLVPETAKGKPELQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVAAQSPAIVAAVQGNLLPSASPLPDPGTPLPPDPTAPSPGTVTPVPPPQ

SEQ ID NO: 65990 - protein, 474 aa, Homo sapiens
MAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKQKRKLRIFISNTFNPAKSDAEDGEGTVASWELRVEGRLLEDSALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQQEIATLDNKTMTDVVGNPEEERRAEFYFQPWAQEAVCRYFYSKVQQRRQELEQALGIRNT

SEQ ID NO: 65991 - protein, 515 aa, Homo sapiens
MAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKQKRKLRIFISNTFNPAKSDAEDGEGTVASWELRVEGRLLEDSALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQQEIATLDNKIHETIETINQLKTQREFMLSFARDPQGFINDWLQSQCRDLKTMTDVVGNPEEERRAEFYFQPWAQEAVCRYFYSKVQQRRQELEQALGIRNT

SEQ ID NO: 65992 - protein, 291 aa, Homo sapiens
MMPLNKRGSSLPFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQQEIATLDNKIHETIETINQLKTQREFMLSFARDPQGFINDWLQSQCRDLKTMTDVVGNPEEERRAEFYFQPWAQEAVCRYFYSKVQQRRQELEQALGIRNT

SEQ ID NO: 65993 - protein, 473 aa, Homo sapiens
MLPGPALRGPGPAQYQRPGMSPGNRMPMALAGGTPCWLPIWCSSSASTWHATHHDGSIPKTPACAPQPPMPAQRRGLKRRKMADKVLPQRIRELVPESQAYMDLLAFERKLDQTIARKRMEIQEAIKKPLTQKRKLRIYISNTFSPSKAEGDSAGTAGTPGGTPAGDKVASWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 65994 - protein, 483 aa, Homo sapiens
MGRRVGVEVTPRWAPQKCQGARPQRPGMSPGNRMPMAGLQVGPPAGSPFGAAAPLRPGMPPTMMDPFRKRLLVPQAQPPMPAQRRGLKRRKMADKVLPQRIRELVPESQAYMDLLAFERKLDQTIARKRMEIQEAIKKPLTQKRKLRIYISNTFSPSKAEGDSAGTAGTPGGTPAGDKVASWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 65995 - protein, 531 aa, Homo sapiens
MSGRGAGGFPLPPLSPGGGAVAAALGAPPPPAGPGMLPGPALRGPGPAGGVGGPGAAAFRPMGPAGPAAQYQRPGMSPGNRMPMAGLQVGPPAGSPFGAAAPLRPGMPPTMMDPFRKRLLVPQAQPPMPAQRRGLKRRKMADKVLPQRIRELVPESQAYMDLLAFERKLDQTIARKRMEIQEAIKKPLTQKRKLRIYISNTFSPSKAEGDSAGTAGTPGGTPAGDKVASWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 65996 - protein, 494 aa, Homo sapiens
MSGRGAGGFPLPPLSPGGGAAFRPMGPAGPAAQYQRPGMSPGNRMPMAGLQVGPPAGSPFGAAAPLRPGMPPTMMDPFRKRLLVPQAQPPMPAQRRGLKRRKMADKVLPQRIRELVPESQAYMDLLAFERKLDQTIARKRMEIQEAIKKPLTQKRKLRIYISNTFSPSKAEGDSAGTAGTPGGTPAGDKVASWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 65997 - protein, 483 aa, Homo sapiens
MAADEVAGGARKATKSKLFEFLVHGVRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 65998 - protein, 435 aa, Homo sapiens
MTPGLQHPPTVVQRPGMPSGARMPHQGAPMGPPGSPYMGSPAAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 65999 - protein, 470 aa, Homo sapiens
MTPGLQHPPTVVQRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 66000 - protein, 470 aa, Homo sapiens; identical to SEQ ID NO: 65999

SEQ ID NO: 66001 - protein, 139 aa, Homo sapiens
MTPGLQHPPTVVQRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMK

SEQ ID NO: 66002 - protein, 1026 aa, Homo sapiens
MNLFNLDRFRFEKRNKIEEAPEATPQPSQPGPSSPISLSAEEENAEGEVSRANTPDSDITEKTEDSSVPETPDNERKASISYFKNQRGIQYIDLSSDSEDVVSPNCSNTVQEKTFNKDTVIIVSEPSEDEESQGLPTMARRNDDISELEDLSELEDLKDAKLQTLKELFPQRSDNDLLKLIESTSTMDGAIAAALLMFGDAGGGPRKRKLSSSSEPYEEDEFNDDQSIKKTRLDHGEESNESAESSSNWEKQESIVLKLQKEFPNFDKQELREVLKEHEWMYTEALESLKVFAEDQDMQYVSQSEVPNGKEVSSRSQNYPKNATKTKLKQKFSMKAQNGFNKKRKKNVFNPKRVVEDSEYDSGSDVGSSLDEDYSSGEEVMEDGYKGKILHFLQDASIGELTLIPQCSQKKAQKITELRPFNSWEALFTKMSKTNGLSEDLIWHCKTLIQERDVVIRLMNKCEDISNKLTKQVTMLTGNGGGWNIEQPSILNQSLSLKPYQKVGLNWLALVHKHGLNGILADEMGLGKTIQAIAFLAYLYQEGNNGPHLIVVPASTIDNWLREVNLWCPTLKVLCYYGSQEERKQIRFNIHSRYEDYNVIVTTYNCAISSSDDRSLFRRLKLNYAIFDEGHMLKNMGSIRYQHLMTINANNRLLLTGTPVQNNLLELMSLLNFVMPHMFSSSTSEIRRMFSSKTKSADEQSIYEKERIAHAKQIIKPFILRRVKEEVLKQLPPKKDRIELCAMSEKQEQLYLGLFNRLKKSINNLEKNTEMCNVMMQLRKMANHPLLHRQYYTAEKLKEMSQLMLKEPTHCEANPDLIFEDMEVMTDFELHVLCKQYRHINNFQLDMDLILDSGKFRVLGCILSELKQKGDRVVLFSQFTMMLDILEVLLKHHQHRYLRLDGKTQISERIHLIDEFNTDMDIFVFLLSTKAGGLGINLTSANVVILHDIDCNPYNDKQAEDRCHRVGQTKEVLVIKLISQGTIEESMLKINQQKLKLEQDMTTVDEGDEGSMPADIATLLKTSMGL

SEQ ID NO: 66003 - protein, 1028 aa, Homo sapiens
MNLFNLDRFRFEKRNKIEEAPEATPQPSQPGPSSPISLSAEEENAEGEVSRANTPDSDITEKTEDSSVPETPDNERKASISYFKNQRGIQYIDLSSDSEDVVSPNCSNTVQEKTFNKDTVIIVSEPSEDEESQGLPTMARRNDDISELEDLSELEDLKDAKLQTLKELFPQRSDNDLLKLIESTSTMDGAIAAALLMFGDAGGGPRKRKLSSSSEPYEEDEFNDDQSIKKTRLDHGEESNESAESSSNWEKQESIVLKLQKEFPNFDKQELREVLKEHEWMYTEALESLKVFAEDQDMQYVSQSEVPNGKEVSSRSQNYPKNATKTKLKQKFSMKAQNGFNKKRKKNVFNPKRVVEDSEYDSGSDVGSSLDEDYSSGEEVMEDGYKGKILHFLQDASIGELTLIPQCSQKKAQKITELRPFNSWEALFTKMSKTNGLSEDLIWHCKTLIQERDVVIRLMNKCEDISNKLTKQVTMLTGNGGGWNIEQPSILNQSLSLKPYQKVGLNWLALVHKHGLNGILADEMGLGKTIQAIAFLAYLYQEGNNGPHLIVVPASTIDNWLREVNLWCPTLKVLCYYGSQEERKQIRFNIHSRYEDYNVIVTTYNCAISSSDDRSLFRRLKLNYAIFDEGHMLKNMGSIRYQHLMTINANNRLLLTGTPVQNNLLELMSLLNFVMPHMFSSSTSEIRRMFSSKTKSADEQSIYEKERIAHAKQIIKPFILRRVKEEVLKQLPPKKDRIELCAMSEKQEQLYLGLFNRLKKSINNLVTEKNTEMCNVMMQLRKMANHPLLHRQYYTAEKLKEMSQLMLKEPTHCEANPDLIFEDMEVMTDFELHVLCKQYRHINNFQLDMDLILDSGKFRVLGCILSELKQKGDRVVLFSQFTMMLDILEVLLKHHQHRYLRLDGKTQISERIHLIDEFNTDMDIFVFLLSTKAGGLGINLTSANVVILHDIDCNPYNDKQAEDRCHRVGQTKEVLVIKLISQGTIEESMLKINQQKLKLEQDMTTVDEGDEGSMPADIATLLKTSMGL

SEQ ID NO: 66004 - protein, 1028 aa, Homo sapiens; identical to SEQ ID NO: 66003

SEQ ID NO: 66005 - protein, 318 aa, Homo sapiens
MNLFNLDRFRFEKRNKIEEAPEATPQPSQPGPSSPISLSAEEENAEGEVSRANTPDSDITEKTEDSSVPETPDNERKASISYFKNQRGIQYIDLSSDSEDVVSPNCSNTVQEKTFNKDTVIIVSEPSEDEESQGLPTMARRNDDISELEDLSELEDLKDAKLQTLKELFPQRSDNDLLKLIESTSTMDGAIAAALLMFGDAGGGPRKRKLSSSSEPYEEDEFNDDQSIKKTRLDHGEESNESAESSSNWEKQESIVLKLQKEFPNFDKQELREVLKEHEWMYTEALESLKVFAEDQDMQYVSQSEVPNGKKKAQKKKK

SEQ ID NO: 66006 - protein, 243 aa, Homo sapiens
MAAIAASEVLVDSAEEGSLAAAAELAAQKREQRLRKFRELHLMRNEARKLNHQEVVEEDKRLKLPANWEAKKARLEWELKEEEKKKECAARGEDYEKVKLLEISAEDAERWERKKKRKNPDLGFSDYAAAQLRQYHRLTKQIKPDMETYERLREKHGEEFFPTSNSLLHGTHVPSTEEIDRMVIDLEKQIEKRDKYSRRRPYNDDADIDYINERNAKFNKKAERFYGKYTAEIKQNLERGTAV

SEQ ID NO: 66007 - protein, 201 aa, Homo sapiens
MAAIAASEVLVDSAEEGSLAAAAELAAQKREQRLRKFRELHLMRECAARGEDYEKVKLLEISAEDAERWERKKKRKNPDLGFSDYAAAQLRQYHRLTKQIKPDMETYERLREKHGEEFFPTSNSLLHGTHVPSTEEIDRMVIDLEKQIEKRDKYSRRRPYNDDADIDYINERNAKFNKKAERFYGKYTAEIKQNLERGTAV

SEQ ID NO: 66008 - protein, 258 aa, Homo sapiens
MDGIIEQKSMLVHSKISDAGKRNGLINTRNLMAESRDGLVSVYPAPQYQSHRVGASTVPASLDSSRSEPMQQLLDPNTLQQSVESRYRPNIILYSEGVLRSWGDGVAADCCETTFIEDRSPTKDSLEYPDGKFIDLSADDIKIHTLSYDVEEEEEFQELESDYSSDTESEDNFLMMPPRDHLGLSVFSMLCCFWPLGIAAFYLSHETNKAVAKGDLHQASTSSRRALFLAVLSITIGTGVYVGVAVALIAYLSKNNHL

SEQ ID NO: 66009 - protein, 238 aa, Homo sapiens
MESLSELQNPLLPRSPAHLHGPYPYPETPPSWSCQEKLYSYLLGGAGPAGAHQLLDPGSLQLAVEAWYRPSCLLGRDKVKEPRAGSCETSFTEDREPQEGPPEQPTGPGQAAENVTIQTVSYGVQEELRDQEDDQEEEESDATSTESESEDNFLTLPPRDHLGLTLFSMLCCFWPLGIAAFYFSQGTSKAISKGDFRLASTTSRRALFLATLAIAVGAGLYVAVVVALAAYMSQNGHG

SEQ ID NO: 66010 - protein, 238 aa, Homo sapiens; identical to SEQ ID NO: 66009

SEQ ID NO: 66011 - protein, 80 aa, Homo sapiens
MESLSELQNPLLPRSPAHLHGPYPYPETPPSWSCQEKLYSYLLGGAGPAGAHQLLDPGSLQLAVEAWYRPSCLLGRDKVK

SEQ ID NO: 66012 - protein, 705 aa, Homo sapiens
MNYLRRRLSDSNFMANLPNGYMTDLQRPQPPPPPPGAHSPGATPGPGTATAERSSGVAPAASPAAPSPGSSGGGGFFSSLSNAVKQTTAAAAATFSEQVGGGSGGAGRGGAASRVLLVIDEPHTDWAKYFKGKKIHGEIDIKVEQAEFSDLNLVAHANGGFSVDMEVLRNGVKVVRSLKPDFVLIRQHAFSMARNGDYRSLVIGLQYAGIPSVNSLHSVYNFCDKPWVFAQMVRLHKKLGTEEFPLIDQTFYPNHKEMLSSTTYPVVVKMGHAHSGMGKVKVDNQHDFQDIASVVALTKTYATAEPFIDAKYDVRVQKIGQNYKAYMRTSVSGNWKTNTGSAMLEQIAMSDRYKLWVDTCSEIFGGLDICAVEALHGKDGRDHIIEVVGSSMPLIGDHQDEDKQLIVELVVNKMAQALPRQRQRDASPGRGSHGQTPSPGALPLGRQTSQQPAGPPAQQRPPPQGGPPQPGPGPQRQGPPLQQRPPPQGQQHLSGLGPPAGSPLPQRLPSPTSAPQQPASQAAPPTQGQGRQSRPVAGGPGAPPAARPPASPSPQRQAGPPQATRQTSVSGPAPPKASGAPPGGQQRQGPPQKPPGPAGPTRQASQAGPVPRTGPPTTQQPRPSGPGPAGRPKPQLAQKPSQDVPPPATAAAGGPPHPQLNKSQSLTNAFNLPEPAPPRPSLSQDEVKAETIRSLRKSFASLFSD

SEQ ID NO: 66013 - protein, 669 aa, Homo sapiens
MNYLRRRLSDSNFMANLPNGYMTDLQRPQPPPPPPGAHSPGATPGPGTATAERSSGVAPAASPAAPSPGSSGGGGFFSSLSNAVKQTTAAAAATFSEQVGGGSGGAGRGGAASRVLLVIDEPHTDWAKYFKGKKIHGEIDIKVEQAEFSDLNLVAHANGGFSVDMEVLRNGVKVVRSLKPDFVLIRQHAFSMARNGDYRSLVIGLQYAGIPSVNSLHSVYNFCDKPWVFAQMVRLHKKLGTEEFPLIDQTFYPNHKEMLSSTTYPVVVKMGHAHSGMGKVKVDNQHDFQDIASVVALTKTYATAEPFIDAKYDVRVQKIGQNYKAYMRTSVSGNWKTNTGSAMLEQIAMSDRYKLWVDTCSEIFGGLDICAVEALHGKDGRDHIIEVVGSSMPLIGDHQDEDKQLIVELVVNKMAQALPRQRQRDASPGRGSHGQTPSPGALPLGRQTSQQPAGPPAQQRPPPQGGPPQPGPGPQRQGPPLQQRPPPQGQQHLSGLGPPAGSPLPQRLPSPTSAPQQPASQAAPPTQGQGRQSRPVAGGPGAPPAARPPASPSPQRQAGPPQATRQTSVSGPAPPKASGAPPGGQQRQGPPQKPPGPAGPTRQASQAGPVPRTGPPTTQQPRPSGPGPAGRPKPQLAQKPSQDVPPPATAAAGGPPHPQLKASPAQAQP

SEQ ID NO: 66014 - protein, 580 aa, Homo sapiens
MNFLRRRLSDSSFMANLPNGYMTDLQRPDSSTSSPASPAMERRHPQPLAASFSSPGSSLFSSLSSAMKQAPQATSGLMEPPGPSTPIVQRPRILLVIDDAHTDWSKYFHGKKVNGEIEIRVEQAEFSELNLAAYVTGGCMVDMQVVRNGTKVVSRSFKPDFILVRQHAYSMALGEDYRSLVIGLQYGGLPAVNSLYSVYNFCSKPWVFSQLIKIFHSLGPEKFPLVEQTFFPNHKPMVTAPHFPVVVKLGHAHAGMGKIKVENQLDFQDITSVVAMAKTYATTEAFIDSKYDIRIQKIGSNYKAYMRTSISGNWKANTGSAMLEQVAMTERYRLWVDSCSEMFGGLDICAVKAVHSKDGRDYIIEVMDSSMPLIGEHVEEDRQLMADLVVSKMSQLPMPGGTAPSPLRPWAPQIKSAKSPGQAQLGPQLGQPQPRPPPQGGPRQAQSPQPQRSGSPSQQRLSPQGQQPLSPQSGSPQQQRSPGSPQLSRASSGSSPNQASKPGATLASQPRPPVQGRSTSQQGEESKKPAPPHPHLNKSQSLTNSLSTSDTSQRGTPSEDEAKAETIRNLRKSFASLFSD

SEQ ID NO: 66015 - protein, 580 aa, Homo sapiens; identical to SEQ ID NO: 66014

SEQ ID NO: 66016 - protein, 444 aa, Homo sapiens
MNFLRRRLSDSSFMANLPNGYMTDLQRPDSSTSSPASPAMERRHPQPLAASFSSPGSSLFSSLSSAMKQAPQATSGLMEPPGPSTPIVQRPRILLVIDDAHTDWSKYFHGKKVNGEIEIRVEQAEFSELNLAAYVTGGCMVDMQVVRNGTKVVSRSFKPDFILVRQHAYSMALGEDYRSLVIGLQYGGLPAVNSLYSVYNFCSKPWVFSQLIKIFHSLGPEKFPLVEQTFFPNHKPMVTAPHFPVVVKLGHAHAGMGKIKVENQLDFQDITSVVAMAKTYATTEAFIDSKYDIRIQKIGSNYKAYMRTSISGNWKANTGSAMLEQVAMTERYRLWVDSCSEMFGGLDICAVKAVHSKDGRDYIIEVMDSSMPLIGEHVEEDRQLMADLVVSKMSQLPMPGGTAPSPLRPWAPQIKSAKSPGQAQLGPQLGQPQPRPPPQVSFSP

SEQ ID NO: 66017 - protein, 113 aa, Homo sapiens
MNFLRRRLSDSSFMANLPNGYMTDLQRPDSSTSSPASPAMERRHPQPLAASFSSPGSSLFSSLSSAMKQAPQATSGLMEPPGPSTPIVQRPRILLVIDDAHTDWSKYFHGKKV

SEQ ID NO: 66018 - protein, 123 aa, Homo sapiens
MNFLRRRLSDSSFMANLPNGYMTDLQRPDSSTSSPASPAMERRHPQPLAASFSSPGSSLFSSLSSAMKQAPQATSGLMEPPGPSTPIVQRPRILLVIDDAHTDWSKYFHGKKVNGEIEIRVEQ

SEQ ID NO: 66019 - protein, 186 aa, Homo sapiens
MDSSMPLIGEHVEEDRQLMADLVVSKMSQLPMPGGTAPSPLRPWAPQIKSAKSPGQAQLGPQLGQPQPRPPPQGGPRQAQSPQQQRSPGSPQLSRASSGSSPNQASKPGATLASQPRPPVQGRSTSQQGEESKKPAPPHPHLNKSQSLTNSLSTSDTSQRGTPSEDEAKAETIRNLRKSFASLFSD

SEQ ID NO: 66020 - protein, 118 aa, Homo sapiens
MEGGAYGAGKAGGAFDPYTLVRQPHTILRVVSWLFSIVVFGSIVNEGYLNSASEGEEFCIYNRNPNACSYGVAVGVLAFLTCLLYLALDVYFPQISSVKDRKKAVLSDIGVSAWEMHS

SEQ ID NO: 66021 - protein, 191 aa, Homo sapiens
MEGGAYGAGKAGGAFDPYTLVRQPHTILRVVSWLFSIVVFGSIVNEGYLNSASEGEEFCIYNRNPNACSYGVAVGVLAFLTCLLYLALDVYFPQISSVKDRKKAVLSDIGVSAFWAFLWFVGFCYLANQWQVSKPKDNPLNEGTDAARAAIAFSFFSIFTWSLTAALAVRRFKDLSFQEEYSTLFPASAQP

SEQ ID NO: 66022 - protein, 233 aa, Homo sapiens
MEGGAYGAGKAGGAFDPYTLVRQPHTILRVVSWLFSIVVFGSIVNEGYLNSASEGEEFCIYNRNPNACSYGVAVGVLAFLTCLLYLALDVYFPQISSVKDRKKAVLSDIGVSAFWAFLWFVGFCYLANQWQVSKPKDNPLNEGTDAARAAIAFSFFSIFTWAGQAVLAFQRYQIGADSALFSQDYMDPSQDSSMPYAPYVEPTGPDPAGMGGTYQQPANTFDTEPQGYQSQGY

SEQ ID NO: 66023 - protein, 192 aa, Homo sapiens
MLTLEFGILEFDPSWIGSWTQRSWVSWRSRPGCELFSIVVFGSIVNEGYLNSASEGEEFCIYNRNPNACSYGVAVGVLAFLTCLLYLALDVYFPQISSVKDRKKAVLSDIGVSAFWAFLWFVGFCYLANQWQVSKPKDNPLNEGTDAARAAIAFSFFSIFTWSLTAALAVRRFKDLSFQEEYSTLFPASAQP

SEQ ID NO: 66024 - protein, 169 aa, Homo sapiens
MEGGAYGAGKAGGAFDPYTLVRQPHTILRVVSWLFSIVVFGSIVNEGYLNSASEGEEFCIYNRNPNACSYGVAVGVLAFLTCLLYLALDVYFPQISSVKDRKKAVLSDIGVSAFWAFLWFVGFCYLANQWQVSKPKDNPLNEGTDAARAAIAFSFFSIFTWRSGATSPP

SEQ ID NO: 66025 - protein, 224 aa, Homo sapiens
MESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWGVLASLAYQRYKAGVDDFIQNYVDPTPDPNTAYASYPGASVDNYQQPPFTQNAETTEGYQPPPVY

SEQ ID NO: 66026 - protein, 229 aa, Homo sapiens
MEGASFGAGRAGAALDPVSFARRPQTLLRVASWVFSIAVFGPIVNEGYVNTDSGPELRCVFNGNAGACRFGVALGLGAFLACAAFLLLDVRFQQISSVRDRRRAVLLDLGFSGLWSFLWFVGFCFLTNQWQRTAPGPATTQAGDAARAAIAFSFFSILSWVALTVKALQRFRLGTDMSLFATEQLSTGASQAYPGYPVGSGVEGTETYQSPPFTETLDTSPKGYQVPAY

SEQ ID NO: 66027 - protein, 145 aa, Homo sapiens
MEGASFGAGRAGAALDPVSFARRPQTLLRVASWVFSIAVFGPIVNEGYVNTDSGPELRCVFNGNAGACRFGVALGLGAFLACAAFLLLDVRFQQSGGRGKTPPSPQDWGSWPLFPSHVPVGSDCLVSVMVVRPVRSHSPLSLTGC

SEQ ID NO: 66028 - protein, 234 aa, Homo sapiens
MHIPKSLQELANSEAVQFLRRPKTITRVFEGVFSLIVFSSLLTDGYQNKMESPQLHCILNSNSVACSFAVGAGFLAFLSCLAFLVLDTQETRIAGTRFKTAFQLLDFILAVLWAVVWFMGFCFLANQWQHSPPKEFLLGSSSAQAAIAFTFFSILVWIFQAYLAFQDLRNDAPVPYKRFLDEGGMVLTTLPLPSANSPVNMPTTGPNSLSYASSALSPCLTAPKSPRLAMMPDN

SEQ ID NO: 66029 - protein, 1573 aa, Homo sapiens
MAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGKQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKLKDGARSVTRTIQNNFFDSSKQEAIDVLLLGNTLNSDLADKARALLTTGSLRVSEQTLQSASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPLPQKDPAQPLEPKRPPPPRPVAPPTRPAPPQRPPPPSGARSPAPTRKEFGGIGAPPSPGVARREMEAPKSPGTTRKDNIGRSQPSPQAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQVKTNGISDGKRESPLKIDPFEDLSFNLLAVSKAQLSVQTSPVPTPDPKRLIQLPSATQSNVLSSVSCMPTMPPIPARSQSQENMRSSPNPFITGLTRTNPFSDRTAAPGNPFRAKSEESEATSWFSKEEPVTISPFPSLQPLGHNKSRASSSLDGFKDSFDLQGQSTLKISNPKGWVTFEEEEDFGVKGKSKSACSDLLGNQPSSFSGSNLTLNDDWNKGTNVSFCVLPSRRPPPPPVPLLPPGTSPPVDPFTTLASKASPTLDFTER

SEQ ID NO: 66030 - protein, 1295 aa, Homo sapiens
MAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGKQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKLKDGARSVTRTIQNNFFDSSKQEAIDVLLLGNTLNSDLADKARALLTTGSLRVSEQTLQSASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPLPQKDPAQPLEPKRPPPPRPVAPPTRPAPPQRPPPPSGARSPAPTRKEFGAPKSPGTTRKDNIGRSQPSPQAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQQEQPSG

SEQ ID NO: 66031 - protein, 1526 aa, Homo sapiens
MAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGKQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKAGKLKDGARSVTRTIQNNFFDSSKQEAIDVLLLGNTLNSDLADKARALLTTGSLRASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPLPQKDPAQPLEPKRPPPPRPVAPPTRPAPPQRPPPPSGRSQPSPQAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQVKTNGISDGKRESPLKIDPFEDLSFNLLAVSKAQLSVQTSPVPTPDPKRLIQLPSATQSNVLSSVSCMPTMPPIPARSQSQENMRSSPNPFITGLTRTNPFSDRTAAPGNPFRAKSEESEATSWFSKEEPVTISPFPSLQPLGHNKSRASSSLDGFKDSFDLQGQSTLKISNPKGWVTFEEEEDFGVKGKSKSACSDLLGNQPSSFSGSNLTLNDDWNKGTNVSFCVLPSRRPPPPPVPLLPPGTSPPVDPFTTLASKASPTLDFTER

SEQ ID NO: 66032 - protein, 1350 aa, Homo sapiens
MRKRWACWSGSDAPGGCGGGCGRRRRRSRRKRAASEERRMAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGKQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKLKDGARSVTRTIQNNFFDSSKQEAIDVLLLGNTLNSDLADKARALLTTGSLRVSEQTLQSASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPLPQKDPAQPLEPKRPPPPRPVAPPTRPAPPQRPPPPSGARSPAPTRKEFGGIGAPPSPGVARREMEAPKSPGTTRKDNIGRSQPSPQAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQQEQPSG

SEQ ID NO: 66033 - protein, 1612 aa, Homo sapiens
MRKRWACWSGSDAPGGCGGGCGRRRRRSRRKRAASEERRMAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGKQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKLKDGARSVTRTIQNNFFDSSKQEAIDVLLLGNTLNSDLADKARALLTTGSLRVSEQTLQSASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPLPQKDPAQPLEPKRPPPPRPVAPPTRPAPPQRPPPPSGARSPAPTRKEFGGIGAPPSPGVARREMEAPKSPGTTRKDNIGRSQPSPQAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQVKTNGISDGKRESPLKIDPFEDLSFNLLAVSKAQLSVQTSPVPTPDPKRLIQLPSATQSNVLSSVSCMPTMPPIPARSQSQENMRSSPNPFITGLTRTNPFSDRTAAPGNPFRAKSEESEATSWFSKEEPVTISPFPSLQPLGHNKSRASSSLDGFKDSFDLQGQSTLKISNPKGWVTFEEEEDFGVKGKSKSACSDLLGNQPSSFSGSNLTLNDDWNKGTNVSFCVLPSRRPPPPPVPLLPPGTSPPVDPFTTLASKASPTLDFTER

SEQ ID NO: 66034 - protein, 1496 aa, Homo sapiens
MALSKGLRLLGRLGAEGDCSVLLEARGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFFWNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRHMVLLKEQYGQQVVVNLLGSRGGEEVLNRAFKKLLWASCHAGDTPMINFDFHQFAKGGKLEKLETLLRPQLKLHWEDFDVFTKGENVSPRFQKGTLRMNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQDDSSPADIFAVGFEEMVELSAGNIVNASTTNKKMWGEQLQKAISRSHRYILLTSAQLVGVCLYIFVRPYHVPFIRDVAIDTVKTGMGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 66035 - protein, 581 aa, Homo sapiens
MQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 66036 - protein, 136 aa, Homo sapiens
  MOD_RES (1)..(1): Any amino acid
XGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFF

SEQ ID NO: 66037 - protein, 1288 aa, Homo sapiens
MALSKGLRLLGRLGAEGDCSVLLEARGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFFWNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRHMVLLKEQYGQQVVVNLLGSRGGEEVLNRAFKKLLWASCHAGDTPMINFDFHQFAKGGKLEKLETLLRPQLKLHWEDFDVFTKGENVSPRFQKGTLRMNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQDDSSPADIFAVGFEEMVELSAGNIVNASTTNKKMWGEQLQKAISRSHRYILLTSAQLVGVCLYIFVRPYHVPFIRDVAIDTVKTGMGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKIVFCSRSQASQPCLLLQRHEFVRTVAAQRLASVDTSGSSV

SEQ ID NO: 66038 - protein, 1451 aa, Homo sapiens
MALSKGLRLLGRLGAEGDCSVLLEARGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFFWNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRHMVLLKEQYGQQVVVNLLGSRGGEEVLNRAFKKLLWASCHAGDTPMINFDFHQFAKGGKLEKLETLLRPQLKLHWEDFDVFTKGENVSPRFQKGTLRMNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQDDSSPADIFAVGFEEMVELSAGNIVNASTTNKKMWGEQLQKAISRSHRYILLTSAQLVGVCLYIFVRPYHVPFIRDVAIDTVKTGMGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKAGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 66039 - protein, 92 aa, Homo sapiens
MFLYASGPAPPAGTCRWGGQGGTSLSFLVLVTGCTSVGRIPDAEIYKITATDFYPLQEEAKEEERLIALKKILSSGVFYFSWPNDGSRFDLT

SEQ ID NO: 66040 - protein, 516 aa, Homo sapiens
MFLYASGPAPPAGTCRWGGQGGTSLSFLVLVTGCTSVGRIPDAEIYKITATDFYPLQEEAKEEERLIALKKILSSGVFYFSWPNDGSRFDLTVRTQKQGDDSSEWGNSFFWNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRHMVLLKEQYGQQVVVNLLGSRGGEEVLNRAFKFAKGGKLEKLETLLRPQLKLHWEDFDVFTKGENVSPRFQKGTLRMNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQGEGSDFGGDKIQLHLT

SEQ ID NO: 66041 - protein, 145 aa, Homo sapiens
MNGRVDYLVTEEEINLTRGPSGLGFNIVGGTDQQYVSNDSGIYVSRIKENGAAALDGRLQEGDKILSVNGQDLKNLLHQDAVDLFRNAGYAVSLRVQHRLQVQNGPIGHRGEGDPSGIPIFMVLVPVFALTMVAAWAFMRYRQQL

SEQ ID NO: 66042 - protein, 318 aa, Homo sapiens
MAGRSLTSKAEPTAGAVDRAEKAGGQDTSSQKIEDLMEMVQKLQKVGSLEPRVEVLINRINEVQQAKKKANKDLGEARTICEALQKELDSLHGEKVHLKEILSKKQETLRILRLHCQEKESEAHRKHTMLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVAPRPGRPVTWWS

SEQ ID NO: 66043 - protein, 351 aa, Homo sapiens
MAGRSLTSKAEPTAGAVDRAEKAGGQDTSSQKIEDLMEMVQKLQKVGSLEPRVEVLINRINEVQQAKKKANKDLGEARTICEALQKELDSLHGEKVHLKEILSKKQETLRILRLHCQEKESEAHRKHTMLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVASPKPLKGERPGAAHQAGPDVLIGQEDTLHPDLSPRGFQEIKELF

SEQ ID NO: 66044 - protein, 282 aa, Homo sapiens
MEMVQKLQKVGSLEPRVEVLINRINEVQQAKKKANKDLGEARTICEALQKELDSLHGEKVHLKEILSKKQETLRILRLHCQEKESEAHRKHTMLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVAPRPGRPVTWWS

SEQ ID NO: 66045 - protein, 282 aa, Homo sapiens; identical to SEQ ID NO: 66044

SEQ ID NO: 66046 - protein, 218 aa, Homo sapiens
MERQGVDVPHVKCKDQEPQPLGESKEHPRWEENCEEEAGGGPASASCQLTVLEGKSGLYFSSLDSSIDILQKRAQELIENINKSRQKDHALMTNFRNSLKTKVSDLTEKLEERIYQIYNDHNKIIQEKLQEFTQKMAKISHLETELKQVCHSVETVYKDLCLQPEQSLRLRWGPDHSRGKSPPRPGNSQPPDVFVSSVAETTSQATASEVQTNRDGEC

SEQ ID NO: 66047 - protein, 976 aa, Homo sapiens
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKYEYEREETRQVYMDLNNNIEKMITAFEELRVQAENSRLEMHFKLKEDYEKIQHLEQEYKKEINDKEKQVSLLLIQITEKENKMKDLTFLLEESRDKVNQLEEKTKLQSENLKQSIEKQHHLTKELEDIKVSLQRSVSTQKALEEDLQIATKTICQLTEEKETQMEESNKARAAHSFVVTEFETTVCSLEELLRTEQQRLEKNEDQLKILTMELQKKSSELEEMTKLTNNKEVELEELKKVLGEKETLLYENKQFEKIAEELKGTEQELIGLLQAREKEVHDLEIQLTAITTSEQYYSKEVKDLKTELENEKLKNTELTSHCNKLSLENKELTQETSDMTLELKNQQEDINNNKKQEERMLKQIENLQETETQLRNELEYVREELKQKRDEVKCKLDKSEENCNNLRKQVENKNKYIEELQQENKALKKKGTAESKQLNVYEIKVNKLELELESAKQKFGEITDTYQKEIEDKKISEENLLEEVEKAKVIADEAVKLQKEIDKRCQHKIAEMVALMEKHKHQYDKIIEERDSELGLYKSKEQEQSSLRASLEIELSNLKAELLSVKKQLEIEREEKEKLKREAKENTATLKEKKDKKTQTFLLETPEIYWKLDSKAVPSQTVSRNFTSVDHGISKDKRDYLWTSAKNTLSTPLPKAYTVKTPTKPKLQQRENLNIPIEESKKKRKMAFEFDINSDSSETTDLLSMVSEEETLKTLYRNNNPPASHLCVKTPKKAPSSLTTPGSTLKFGAIRKMREDRWAVIAKMDRKKKLKEAEKLFV

SEQ ID NO: 66048 - protein, 976 aa, Homo sapiens; identical to SEQ ID NO: 66047

SEQ ID NO: 66049 - protein, 792 aa, Homo sapiens
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKYEYEREETRQVYMDLNNNIEKMITAFEELRVQAENSRLEMHFKLKEDYEKIQHLEQEYKKEINDKEKQVSLLLIQITEKENKMKDLTFLLEESRDKVNQLEEKTKLQSENLKQSIEKQHHLTKELEDIKVSLQRSVSTQKALEEDLQIATKTICQLTEEKETQMEESNKARAAHSFVVTEFETTVCSLEELLRTEQQRLEKNEDQLKILTMELQKKSSELEEMTKLTNNKEVELEELKKVLGEKETLLYENKQFEKIAEELKGTEQELIGLLQAREKEVHDLEIQLTAITTSEQYYSKEVKDLKTELENEKLKNTELTSHCNKLSLENKELTQETSDMTLELKNQQEDINNNKKQEERMLKQIENLQETETQLRNELEYVREELKQKRDEVKCKLDKSEENCNNLRKQVENKNKYIEELQQENKALKKKGTAESKQLNVYEIKVNKLELELESAKQKFGEITDTYQKEIEDKKISEENLLEEVEKAKVIADEAVKLQKEIDKRCQHKIAEMVALMEKHKHQYDKIIEERDSELGLYKSKEQEQSSLRASLEIELSNLKAELLSVKKQLEIEREEKEKLKREAKENTATLKEKK

SEQ ID NO: 66050 - protein, 795 aa, Homo sapiens
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKYEYEREETRQVYMDLNNNIEKMITAFEELRVQAENSRLEMHFKLKEDYEKIQHLEQEYKKEINDKEKQVSLLLIQITEKENKMKDLTFLLEESRDKVNQLEEKTKLQSENLKQSIEKQHHLTKELEDIKVSLQRSVSTQKALEEDLQIATKTICQLTEEKETQMEESNKARAAHSFVVTEFETTVCSLEELLRTEQQRLEKNEDQLKILTMELQKKSSELEEMTKLTNNKEVELEELKKVLGEKETLLYENKQFEKIAEELKGTEQELIGLLQAREKEVHDLEIQLTAITTSEQYYSKEVKDLKTELENEKLKNTELTSHCNKLSLENKELTQETSDMTLELKNQQEDINNNKKQEERMLKQIENLQETETQLRNELEYVREELKQKRDEVKCKLDKSEENCNNLRKQVENKNKYIEELQQENKALKKKGTAESKQLNVYEIKVNKLELELESAKQKFGEITDTYQKEIEDKKISEENLLEEVEKAKVIADEAVKLQKEIDKRCQHKIAEMVALMEKHKHQYDKIIEERDSELGLYKSKEQEQSSLRASLEIELSNLKAELLSVKKQLEIEREEKEKLKREAKENTATLKEKKDKK

SEQ ID NO: 66051 - protein, 1530 aa, Homo sapiens
MPIRPDLQQLEKCIDDALRKNDFKPLKTLLQIDICEDVKIKCSKQFFHKVDNLICRELNKEDIHNVSAILVSVGRCGKNISVLGQAGLLTMIKQGLIQKMVAWFEKSKDIIQSQGNSKDEAVLNMIEDLVDLLLVIHDVSDEGKKQVVESFVPRICSLVIDSRVNICIQQEIIKKMNAMLDKMPQDARKILSNQEMLILMSSMGERILDAGDYDLQVGIVEALCRMTTEKQRQELAHQWFSMDFIAKAFKRIKDSEFETDCRIFLNLVNGMLGDKRRVFTFPCLSAFLDKYELQIPSDEKLEEFWIDFNLGSQTLSFYIAGDNDDHQWEAVTVPEEKVQIYSIEVRESKKLLTIILKNTVKISKREGKELLLYFDASLEITNVTQKIFGATKHRESIRKQGISVAKTSLHILFDASGSQILVPESQISPVGEELVSLKEKSKSPKEFAKPSKYIKNSDKGNRNNSQLEKTTPSKRKMSEASMIVSGADRYTMRSPVLFSNTSIPPRRRRIKPPLQMTSSAEKPSVSQTSENRVDNAASLKSRSSEGRHRRDNIDKHIKTAKCVENTENKNVEFPNQNFSELQDVIPDSQAAEKRDHTILPGVLDNICGNKIHSKWACWTPVTNIELCNNQRASTSSGDTLNQDIVINKKLTKQKSSSSISDHNSEGTGKVKYKKEQTDHIKIDKAEVEVCKKHNQQQNHPKYSGQKNTENAKQSDWPVESETTFKSVLLNKTIEESLIYRKKYILSKDVNTATCDKNPSASKNVQSHRKAEKELTSELNSWDSKQKKMREKSKGKEFTNVAESLISQINKRYKTKDDIKSTRKLKESLINSGFSNKPVVQLSKEKVQKKSYRKLKTTFVNVTSECPVNDVYNFNLNGADDPIIKLGIQEFQATAKEACADRSIRLVGPRNHDELKSSVKTKDKKIITNHQKKNLFSDTETEYRCDDSKTDISWLREPKSKPQLIDYSRNKNVKNHKSGKSRSSLEKGQPSSKMTPSKNITKKMDKTIPEGRIRLPRKATKTKKNYKDLSNSESECEQEFSHSFKENIPVKEENIHSRMKTVKLPKKQQKVFCAETEKELSKQWKNSSLLKDAIRDNCLDLSPRSLSGSPSSIEVTRCIEKITEKDFTQDYDCITKSISPYPKTSSLESLNSNSGVGGTIKSPKNNEKNFLCASESCSPIPRPLFLPRHTPTKSNTIVNRKKISSLVLTQETQNSNSYSDVSSYSSEERFMEIESPHINENYIQSKREESHLASSLSKSSEGREKTWFDMPCDATHVSGPTQHLSRKRIYIEDNLSNSNEVEMEEKGERRANLLPKKLCKIEDADHHIHKMSESVSSLSTNDFSIPWETWQNEFAGIEMTYETYERLNSEFKRRNNIRHKMLSYFTTQSWKTAQQHLRTMNHQSQDSRIKKLDKFQFIIIEELENFEKDSQSLKDLEKEFVDFWEKIFQKFSAYQKSEQQRLHLLKTSLAKSVFCNTDSEETVFTSEMCLMKEDMKVLQDRLLKDMLEEELLNVRRELMSVFMSHERNANV

SEQ ID NO: 66052 - protein, 1530 aa, Homo sapiens; identical to SEQ ID NO: 66051

SEQ ID NO: 66053 - protein, 1023 aa, Homo sapiens
MPIRPDLQQLEKCIDDALRKNDFKPLKTLLQIDICEDVKIKCSKQFFHKVDNLICRELNKEDIHNVSAILVSVGRCGKNISVLGQAGLLTMIKQGLIQKMVAWFEKSKDIIQSQGNSKDEAVLNMIEDLVDLLLVIHDVSDEGKKQVVESFVPRICSLVIDSRVNICIQQEIIKKMNAMLDKMPQDARKILSNQEMLILMSSMGERILDAGDYDLQVGIVEALCRMTTEKQRQELAHQWFSMDFIAKAFKRIKDSEFETDCRIFLNLVNGMLGDKRRVFTFPCLSAFLDKYELQIPSDEKLEEFWIDFNLGSQTLSFYIAGDNDDHQWEAVTVPEEKVQIYSIEVRESKKLLTIILKNTVKISKREGKELLLYFDASLEITNVTQKIFGATKHRESIRKQGISVAKTSLHILFDASGSQILVPESQISPVGEELVSLKEKSKSPKEFAKPSKYIKNSDKGNRNNSQLEKTTPSKRKMSEASMIVSGADRYTMRSPVLFSNTSIPPRRRRIKPPLQMTSSAEKPSVSQTSENRVDNAASLKSRSSEGRHRRDNIDKHIKTAKCVENTENKNVEFPNQNFSELQDVIPDSQAAEKRDHTILPGVLDNICGNKIHSKWACWTPVTNIELCNNQRASTSSGDTLNQDIVINKKLTKQKSSSSISDHNSEGTGKVKYKKEQTDHIKIDKAEVEVCKKHNQQQNHPKYSGQKNTENAKQSDWPVESETTFKSVLLNKTIEESLIYRKKYILSKDVNTATCDKNPSASKNVQSHRKAEKELTSELNSWDSKQKKMREKSKGKEFTNVAESLISQINKRYKTKDDIKSTRKLKESLINSGFSNKPVVQLSKEKVQKKSYRKLKTTFVNVTSECPVNDVYNFNLNGADDPIIKLGIQEFQATAKEACADRSIRLVGPRNHDELKSSVKTKDKKIITNHQKKNLFSDTETEYRCDDSKTDISWLREPKSKPQLIDYSRNKNVKNHKSGKSRSSLEKGQPSSKMTPSKNITKKMDKTIPEGRIRLPRKATKTKK

SEQ ID NO: 66054 - protein, 236 aa, Homo sapiens
MVSSGKKYSRKSGKPSVEDQFTRAYDFETEDKKDLSGSEEDVIEGKTAVIEKRRKKRSSAGVVEDMGGEVQNMLEGVGVDINKALLAKRKRLEMYTKASLKTSNQKIEHVWKTQQDQRQKLNQEYSQQFLTLFQQWDLDMQKAEEQEEKILNMFRQQQKILQQSRIVQSQRLKTIKQLYEQFIKSMEELEKNHDNLLTGAQNEFKKEMAMLQKKIMMETQQQEIASVRKSLQSMLF

SEQ ID NO: 66055 - protein, 236 aa, Homo sapiens; identical to SEQ ID NO: 66054

SEQ ID NO: 66056 - protein, 236 aa, Homo sapiens; identical to SEQ ID NO: 66054

SEQ ID NO: 66057 - protein, 313 aa, Homo sapiens
MLLLADMDVVNQLVAGGQFRVVKEPLGFVKVLQWVFAIFAFATCGSYSGELQLSVDCANKTESDLSIEVEFEYPFRLHQVYFDAPTCRGGTTKVFLVGDYSSSAEFFVTVAVFAFLYSMGALATYIFLQNKYRENNKGPMLDFLATAVFAFMWLVSSSAWAKGLSDVKMATDPENIIKEMPVCRQTGNTCKELRDPVTSGLNTSVVFGFLNLVLWVGNLWFVFKETGWAAPFLRAPPGAPEKQPAPGDAYGDAGYGQGPGGYGPQDSYGPQGGYQPDYGQPAGSGGSGYGPQGDYGQQGYGPQGAPTSFSNQM

SEQ ID NO: 66058 - protein, 313 aa, Homo sapiens; identical to SEQ ID NO: 66057

SEQ ID NO: 66059 - protein, 195 aa, Homo sapiens
MGALATYIFLQNKYRENNKGPMLDFLATAVFAFMWLVSSSAWAKGLSDVKMATDPENIIKEMPVCRQTGNTCKELRDPVTSGLNTSVVFGFLNLVLWVGNLWFVFKETGWAAPFLRAPPGAPEKQPAPGDAYGDAGYGQGPGGYGPQDSYGPQGGYQPDYGQPAGSGGSGYGPQGDYGQQGYGPQGAPTSFSNQM

SEQ ID NO: 66060 - protein, 903 aa, Homo sapiens
MEGYSEEASLLRHLEKVASEEEEVPLVVYLKENAALLTANGLHLSQNREAQQSSPAPPPAEVHSPAADVNQNLASPSATLTTPTSNSSHNPPATDVNQNPPATVVPQSLPLSSIQQNSSEAQLPSNGTGPASKPSTLCADGQPQAPAEEVRCSTLLIDKVSTPATTTSTFSREATLIPSSRPPASDFMSSSLLIDIQPNTLVVSADQEMSGRAAATTPTKVYSEVHFTLAKPPSVVNRTARPFGIQAPGGTSQMERSPMLERRHFGEKAPAPQPPSLPDRSPRPQRHIMSRSPMVERRMMGQRSPASERRPLGNFTAPPTYTETLSTAPLASWVRSPPSYSVLYPSSDPKSSHLKGQAVPASKTGILEESMARRGSRKSMFTFVEKPKVTPNPDLLDLVQTADEKRRQRDQGEVGVEEEPFALGAEASNFQQEPAPRDRASPAAAEEVVPEWASCLKSPRIQAKPKPKPNQNLSEASGKGAELYARRQSRMEKYVIESSSHTPELARCPSPTMSLPSSWKYPTNAPGAFRVASRSPARTPPASLYHGYLPENGVLRPEPTKQPPYQLRPSLFVLSPIKEPAKVSPRAASPAKPSSLDLVPNLPKGALPPSPALPRPSRSSPGLYTSPGQDSLQPTAVSPPYGGDISPVSPSRAWSPRAKQAPRPSFSTRNAGIEAQDRRESLPTSPPWTPGASRPPSSLDGWVSPGPWEPGRGSSMSSPPPLPPPPPMSPSWSERSVSPLRPETEARPPSRQLQALLARNIINAARRKSASPRSAGAENPRPFSPPRAPPPPPPPPPPPPRMRSPQPARPGSAAVPGAAFAPIPRSPLPAGPSSCTSPRSPLPAPPRPFLYRRSPTDSDVSLDSEDSGAKSPGILGYNICPRGWNGSLRLKRGSLPAEASCTT

SEQ ID NO: 66061 - protein, 929 aa, Homo sapiens
MLGPHLPPPPLAPSEGRPTPCAFQIPDGSYRCLALEAEESSGEEGLQGEVGPTDLEEDEGVSRSGDDSACRVTQGTPQLPKALGIQPPSCSREEQGASQHDDRASQDWDVVKAGQMMTASPSPGPGPRVAQKPALGRSTSLTEKDLKEAKARSQQIAAQLTTPPSSNSRGVQLFNRRRQRVNEFTLESHGQRGQKPSQESLRVLPSSLPGHAPGLSLSSTSLPEPGPPRHPSPQSPDRGVPGHSMEGYSEEASLLRHLEKVASEEEEVPLVVYLKENAALLTANGLHLSQNREAQQSSPAPPPAEVHSPAADVNQNLASPSATLTTPTSNSSHNPPATDVNQNPPATVVPQSLPLSSIQQNSSEAQLPSNGTGPASKPSTLCADGQPQAPAEEVRCSTLLIDKVSTPATTTSTFSREATLIPSSRPPASDFMSSSLLIDIQPNTLVVSADQEMSGRAAATTPTKVYSEVHFTLAKPPSVVNRTARPFGIQAPGGTSQMERSPMLERRHFGEKAPAPQPPSLPDRSPRPQRHIMSRSPMVERRMMGQRSPASERRPLGNFTAPPTYTETLSTAPLASWVRSPPSYSVLYPSSDPKSSHLKGQAVPASKTGILEESMARRGSRKSMFTFVEKPKVTPNPDLLDLVQTADEKRRQRDQGEVGVEEEPFALGAEASNFQQEPAPRDRASPAAAEEVVPEWASCLKSPRIQAKPKPKPNQNLSEASGKGAELYARRQSRMEKYVIESSSHTPELARCPSPTMSLPSSWKYPTNAPGAFRVASRSPARTPPASLYHGYLPENGVLRPEPTKQPPYQLRPSLFVLSPIKEPAKVSPRAASPAKPSSLDLVPNLPKGALPPSPALPRPSRSSPGLYTSPGQDSLQPTAVSPPYGGDISPVSPSRAWSPRAKQAPRPSFSTRNAGIEAQVWKPSFCFK

SEQ ID NO: 66062 - protein, 685 aa, Homo sapiens
MEGYSEEASLLRHLEKVASEEEEVPLVVYLKENAALLTANGLHLSQNREAQQSSPAPPPAEVHSPAADVNQNLASPSATLTTPTSNSSHNPPATDVNQNPPATVVPQSLPLSSIQQNSSEAQLPSNGTGPASKPSTLCADGQPQAPAEEVRCSTLLIDKVSTPATTTSTFSREATLIPSSRPPASDFMSSSLLIDIQPNTLVVSADQEMSGRAAATTPTKVYSEVHFTLAKPPSVVNRTARPFGIQAPGGTSQMERSPMLERRHFGEKAPAPQPPSLPDRSPRPQRHIMSRSPMVERRMMGQRSPASERRPLGNFTAPPTYTETLSTAPLASWVRSPPSYSVLYPSSDPKSSHLKGQAVPASKTGILEESMARRGSRKSMFTFVEKPKVTPNPDLLDLVQTADEKRRQRDQGEVGVEEEPFALGAEASNFQQEPAPRDRASPAAAEEVVPEWASCLKSPRIQAKPKPKPNQNLSEASGKGAELYARRQSRMEKYVIESSSHTPELARCPSPTMSLPSSWKYPTNAPGAFRVASRSPARTPPASLYHGYLPENGVLRPEPTKQPPYQLRPSLFVLSPIKEPAKVSPRAASPAKPSSLDLVPNLPKGALPPSPALPRPSRSSPGLYTSPGQDSLQPTAVSPPYGGDISPVSPSRAWSPRAKQAPRPSFSTRNAGIEAQVWKPSFCFK

SEQ ID NO: 66063 - protein, 929 aa, Homo sapiens; identical to SEQ ID NO: 66061

SEQ ID NO: 66064 - protein, 211 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNRTKNFESGKAYKTTWGDGGENSPCNVVSKQPGPVTNGQLQQPTTGAASGGYIKRITNDAREDEMEENLTQVGSILGNLKDMALNIGNEIDAQNPQIKRITDKADTNRDRIDIANARAKKLIDS

SEQ ID NO: 66065 - protein, 158 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNSITNDAREDEMEENLTQVGSILGNLKDMALNIGNEIDAQNPQIKRITDKADTNRDRIDIANARAKKLIDS

SEQ ID NO: 66066 - protein, 158 aa, Homo sapiens; identical to SEQ ID NO: 66065

SEQ ID NO: 66067 - protein, 206 aa, Homo sapiens
MAEDADMRNELEEMQRRADQLADESLESTRRMLQLVEESKDAGIRTLVMLDEQGEQLERIEEGMDQINKDMKEAEKNLTDLGKFCGLCVCPCNKLKSSDAYKKAWGNNQDGVVASQPARVVDEREQMAISGGFIRRVTNDARENEMDENLEQVSGIIGNLRHMALDMGNEIDTQNRQIDRIMEKADSNKTRIDEANQRATKMLGSG

SEQ ID NO: 66068 - protein, 206 aa, Homo sapiens
MAEDADMRNELEEMQRRADQLADESLESTRRMLQLVEESKDAGIRTLVMLDEQGEQLDRVEEGMNHINQDMKEAEKNLKDLGKCCGLFICPCNKLKSSDAYKKAWGNNQDGVVASQPARVVDEREQMAISGGFIRRVTNDARENEMDENLEQVSGIIGNLRHMALDMGNEIDTQNRQIDRIMEKADSNKTRIDEANQRATKMLGSG

SEQ ID NO: 66069 - protein, 93 aa, Homo sapiens
MAEDADMRNELEEMQRRADQLADESLESTRRMLQLVEESKDAGIRTLVMLDEQGEQLERIEEGMDQINKDMKEAEKNLTDLGKFCGLCVCPCN

SEQ ID NO: 66070 - protein, 258 aa, Homo sapiens
MSAYPKSYNPFDDDGEDEGARPAPWRDARDLPDGPDAPADRQQYLRQEVLRRAEATAASTSRSLALMYESEKVGVASSEELARQRGVLERTEKMVDKMDQDLKISQKHINSIKSVFGGLVNYFKSKPVETPPEQNGTLTSQPNNRLKEAISTSKEQEAKYQASHPNLRKLDDTDPVPRGAGSAMSTDAYPKNPHLRAYHQKIDSNLDELSMGLGRLKDIALGMQTEIEEQDDILDRLTTKVDKLDVNIKSTERKVRQL

SEQ ID NO: 66071 - protein, 422 aa, Homo sapiens
MVSESHHEALAAPPVTTVATVLPSNATEPASPGEGKEDAFSKLKEKFMNELHKIPLPPWALIAIAIVAVLLVLTCCFCICKKCLFKKKNKKKGKEKGGKNAINMKDVKDLGKTMKDQALKDDDAETGLTDGEEKEEPKEEEKLGKLQYSLDYDFQNNQLLVGIIQAAELPALDMGGTSDPYVKVFLLPDKKKKFETKVHRKTLNPVFNEQFTFKVPYSELGGKTLVMAVYDFDRFSKHDIIGEFKVPMNTVDFGHVTEEWRDLQSAEKEEQEKLGDICFSLRYVPTAGKLTVVILEAKNLKKMDVGGLSDPYVKIHLMQNGKRLKKKKTTIKKNTLNPYYNESFSFEVPFEQIQKVQVVVTVLDYDKIGKNDAIGKVFVGYNSTGAELRHWSDMLANPRRPIAQWHTLQVEEEVDAMLAVKK

SEQ ID NO: 66072 - protein, 422 aa, Homo sapiens; identical to SEQ ID NO: 66071

SEQ ID NO: 66073 - protein, 182 aa, Homo sapiens
MVSESHHEALAAPPVTTVATVLPSNATEPASPGEGKEDAFSKLKEKFMNELHKIPLPPWALIAIAIVAVLLVLTCCFCICKKCLFKKKNKKKGKEKGGKNAINMKDVKDLGKTMKDQALKDDDAETGLTDGEEKEEPKEEEKLGKLQYSLDYDFQNNQLLVGIIQAAELPALDMGGTSDPYV

SEQ ID NO: 66074 - protein, 58 aa, Homo sapiens
MVSESHHEALAAPPVTTVATVLPSNATEPASPGEGKEDAFSKLKEKFMNELHKIPLPP

SEQ ID NO: 66075 - protein, 72 aa, Homo sapiens
MVSESHHEALAAPPVTTVATVLPSNATEPASPGEGKEDAFSKLKEKFMNELHKIPLPPWALIAIAIVAVLLV

SEQ ID NO: 66076 - protein, 73 aa, Homo sapiens
MVSESHHEALAAPPVTTVATVLPSNATEPASPGEGKEDAFSKLKEKFMNELHKIPLPPWALIAIAIVAVLLVL

SEQ ID NO: 66077 - protein, 94 aa, Homo sapiens
MVSESHHEALAAPPVTTVATVLPSNATEPASPGEGKEDAFSKLKEKFMNELHKIPLPPWALIAIAIVAVLLVLTCCFCICKKCLFKKKNKKKGK

SEQ ID NO: 66078 - protein, 422 aa, Homo sapiens; identical to SEQ ID NO: 66071

SEQ ID NO: 66079 - protein, 590 aa, Homo sapiens
MSGDYEDDLCRRALILVSDLCARVRDADTNDRCQEFNDRIRGYPRGPDADISVSLLSVIVTFCGIVLLGVSLFVSWKLCWVPWRDKGGSAVGGGPLRKDLGPGVGLAGLVGGGGHHLAAGLGGHPLLGGPHHHAHAAHHPPFAELLEPGSLGGSDTPEPSYLDMDSYPEAAAAAVAAGVKPSQTSPELPSEGGAGSGLLLLPPSGGGLPSAQSHQQVTSLAPTTRYPALPRPLTQQTLTSQPDPSSEERPPALPLPLPGGEEKAKLIGQIKPELYQGTGPGGRRSGGGPGSGEAGTGAPCGRISFALRYLYGSDQLVVRILQALDLPAKDSNGFSDPYVKIYLLPDRKKKFQTKVHRKTLNPVFNETFQFSVPLAELAQRKLHFSVYDFDRFSRHDLIGQVVLDNLLELAEQPPDRPLWRDIVEGGSEKADLGELNFSLCYLPTAGRLTVTIIKASNLKAMDLTGFSDPYVKASLISEGRRLKKRKTSIKKNTLNPTYNEALVFDVAPESVENVGLSIAVVDYDCIGHNEVIGVCRVGPDAADPHGREHWAEMLANPRKPVEHWHQLVEEKTVTSFTKGSKGLSEKENSE

SEQ ID NO: 66080 - protein, 590 aa, Homo sapiens; identical to SEQ ID NO: 66079

SEQ ID NO: 66081 - protein, 590 aa, Homo sapiens; identical to SEQ ID NO: 66079

SEQ ID NO: 66082 - protein, 590 aa, Homo sapiens; identical to SEQ ID NO: 66079

SEQ ID NO: 66083 - protein, 425 aa, Homo sapiens
MAPITTSREEFDEIPTVVGIFSAFGLVFTVSLFAWICCQRKSSKSNKTPPYKFVHVLKGVDIYPENLNSKKKFGADDKNEVKNKPAVPKNSLHLDLEKRDLNGNFPKTNLKPGSPSDLENATPKLFLEGEKESVSPESLKSSTSLTSEEKQEKLGTLFFSLEYNFERKAFVVNIKEARGLPAMDEQSMTSDPYIKMTILPEKKHKVKTRVLRKTLDPAFDETFTFYGIPYTQIQELALHFTILSFDRFSRDDIIGEVLIPLSGIELSEGKMLMNREIIKRNVRKSSGRGELLISLCYQSTTNTLTVVVLKARHLPKSDVSGLSDPYVKVNLYHAKKRISKKKTHVKKCTPNAVFNELFVFDIPCEGLEDISVEFLVLDSERGSRNEVIGQLVLGAAAEGTGGEHWKEICDYPRRQIAKWHVLCDG

SEQ ID NO: 66084 - protein, 230 aa, Homo sapiens
MDLLSEKKHKVKTRVLRKTLDPAFDETFTFYGIPYTQIQELALHFTILSFDRFSRDDIIGEVLIPLSGIELSEGKMLMNREIIKRNVRKSSGRGELLISLCYQSTTNTLTVVVLKARHLPKSDVSGLSDPYVKVNLYHAKKRISKKKTHVKKCTPNAVFNELFVFDIPCEGLEDISVEFLVLDSERGSRNEVIGQLVLGAAAEGTGGEHWKEICDYPRRQIAKWHVLCDG

SEQ ID NO: 66085 - protein, 491 aa, Homo sapiens
MPGARDALCHQALQLLAELCARGALEHDSCQDFIYHLRDRARPRLRDPDISVSLLTLVVTACGLALFGVSLFVSWKLCWVPWRERGLPSGSKDNNQEPLNYMDTETNEQENSEDFLDPPTPCPDSSMKISHTSPDIPLSTQTGIQENCAHGVRVQRQVTEPTSSARHNSIRRQLNLSNPDFNIQQLQKQEQLTGIGRIKPELYKQRSLDNDDGRRSNSKACGKLNFILKYDCDLEQLIVKIHKAVNLPAKDFSGTSDPYVKIYLLPDRKTKHQTKVHRKTLNPVFDEVFLFPVPYNDLEARKLHFSVYDFDRFSRHDLIGQVVVDHFLDLADFPRECILWKDIEYVTNDNVDLGELMFSLCYLPTAGRLTITIIKARNLKAMDITGASDPYVKVSLMCDGRRLKKRKTSTKRNTLNPVYNEAIVFDVPPENIDQIHLSIAVMDYDRVGHNEIIGVCQVGNEAERLGRDHWSEMLSYPRKPIAHWHSLVEKR

SEQ ID NO: 66086 - protein, 319 aa, Homo sapiens
MLAKVVEGDLAFKGGRDISVSLLTLVVTACGLALFGVSLFVSWKLCWVPWRERGLPSGSKDNNQEPLNYMDTETNEQENSEDFLDPPTPCPDSSMKISHTSPDIPLSTQTGIQENCAHGVRVQRQVTEPTSSARHNSIRRQLNLSNPDFNIQQLQKQEQLTGIGRIKPELYKQRSLDNDDGRRSNSKACGKLNFILKYDCDLEQLIVKIHKAVNLPAKDFSGTSDPYVKIYLLPDRKTKHQTKVHRKTLNPVFDEVFLFPVPYNDLEARKLHFSVYDFDRFSRHDLIGQVVVDHFLDLADFPRECILWKDIEYVTNILS

SEQ ID NO: 66087 - protein, 386 aa, Homo sapiens
MFPEPPTPGPPSPDTPPDSSRISHGPVPPWALATIVLVSGLLIFSCCFCLYRKSCRRRTGKKSQAQAQVHLQEVKGLGQSYIDKVQPEVEELEPAPSGPGQQVADKHELGRLQYSLDYDFQSGQLLVGILQAMGLAALDLGGSSDPYVRVYLLPDKRRRYETKVHRQTLNPHFGETFAFKVPYVELGGRVLVMAVYDFDRFSRNDAIGEVRVPMSSVDLGRPVQAWRELQAAPREEQEKLGDICFSLRYVPTAGKLTVIVLEAKNLKKMDVGGLSDPYVKVHLLQGGKKVRKKKTTIKKNTLNPYYNEAFSFEVPCDQVQKVQVELTVLDYDKLGKNEAIGRVAVGAAAGGAGLRHWADMLANPRRPIAQWHSLRPPDRVRLLPAP

SEQ ID NO: 66088 - protein, 386 aa, Homo sapiens; identical to SEQ ID NO: 66087

SEQ ID NO: 66089 - protein, 382 aa, Homo sapiens
MTRGGCPVSARLFAQRPHGSWSSLLCVGLKGRLGWEWGTRVLECLCRKDSRTPPPCSRSPQPRGLHRPTRLPTPVASATAQVQPEVEELEPAPSGPGQQVADKHELGRLQYSLDYDFQSGQLLVGILQAMGLAALDLGGSSDPYVRVYLLPDKRRRYETKVHRQTLNPHFGETFAFKVPYVELGGRVLVMAVYDFDRFSRNDAIGEVRVPMSSVDLGRPVQAWRELQAAPREEEKLGDICFSLRYVPTAGKLTVIVLEAKNLKKMDVGGLSDPYVKVHLLQGGKKVRKKKTTIKKNTLNPYYNEAFSFEVPCDQVQKVQVELTVLDYDKLGKNEAIGRVAVGAAAGGAGLRHWADMLANPRRPIAQWHSLRPPDRVRLLPAP

SEQ ID NO: 66090 - protein, 510 aa, Homo sapiens
MSGVWGAGGPRCQEALAVLASLCRARPPPLGLDVETCRSFELQPPERSPSAAGAGTSVSLLAVVVIVCGVALVAVFLFLFWKLCWMPWRNKEASSPSSANPPLEALQSPSFRGNMADKLKDPSTLGFLEAAVKISHTSPDIPAEVQMSVKEHIMRHTRLQRQTTEPASSTRHTSFKRHLPRQMHVSSVDYGNELPPAAEQPTSIGRIKPELYKQKSVDGEDAKSEATKSCGKINFSLRYDYETETLIVRILKAFDLPAKDFCGSSDPYVKIYLLPDRKCKLQTRVHRKTLNPTFDENFHFPVPYEELADRKLHLSVFDFDRFSRHDMIGEVILDNLFEASDLSRETSIWKDIQYATSESVDLGEIMFSLCYLPTAGRLTLTVIKCRNLKAMDITGYSDPYVKVSLLCDGRRLKKKKTTIKKNTLNPVYNEAIIFDIPPENMDQVSLLISVMDYDRVGHNEIIGVCRVGITAEGLGRDHWNEMLAYPRKPIAHWHSLVEVKKSFKEGNPRL

SEQ ID NO: 66091 - protein, 425 aa, Homo sapiens
MPWRNKEASSPSSANPPLEALQSPSFRGNMADKLKDPSTLGFLEAAVKISHTSPDIPAEVQMSVKEHIMRHTRLQRQTTEPASSTRHTSFKRHLPRQMHVSSVDYGNELPPAAEQPTSIGRIKPELYKQKSVDGEDAKSEATKSCGKINFSLRYDYETETLIVRILKAFDLPAKDFCGSSDPYVKIYLLPDRKCKLQTRVHRKTLNPTFDENFHFPVPYEELADRKLHLSVFDFDRFSRHDMIGEVILDNLFEASDLSRETSIWKDIQYATSESVDLGEIMFSLCYLPTAGRLTLTVIKCRNLKAMDITGYSDPYVKVSLLCDGRRLKKKKTTIKKNTLNPVYNEAIIFDIPPENMDQVSLLISVMDYDRVGHNEIIGVCRVGITAEGLGRDHWNEMLAYPRKPIAHWHSLVEVKKSFKEGNPRL

SEQ ID NO: 66092 - protein, 425 aa, Homo sapiens; identical to SEQ ID NO: 66091

SEQ ID NO: 66093 - protein, 510 aa, Homo sapiens; identical to SEQ ID NO: 66090

SEQ ID NO: 66094 - protein, 95 aa, Homo sapiens
MPWRNKEASSPSSANPPLEALQSPSFRGNMADKLKDPSTLGFLEAAVKISHTSPDIPAEVQMSVKEHIMRHTRLQRQTTEPASSTRHTSFKRHLP

SEQ ID NO: 66095 - protein, 86 aa, Homo sapiens [sequence omitted]

SEQ ID NO: 66096 - protein, 403 aa, Homo sapiens
MYRDPEAASPGAPSRDVLLVSAIITVSLSVTVVLCGLCHWCQRKLGKRYKNSLETVGTPDSGRGRSEKKAIKLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 66097 - protein, 421 aa, Homo sapiens
MAVDVAEYHLSVIKSPPGWEVGVYAAGALALLGIAAVSLWKLWTSGSFPSPSPFPNYDYRYLQQKYGESCAEAREKRVPAWNAQRASTRGPPSRKGSLSIEDTFESISELGPLELMGRELDLAPYGTLRKSQSADSLNSISSVSNTFGQDFTLGQVEVSMEYDTASHTLNVAVMQGKDLLEREEASFESCFMRVSLLPDEQIVGISRIQRNAYSIFFDEKFSIPLDPTALEEKSLRFSVFGIDEDERNVSTGVVELKLSVLDLPLQPFSGWLYLQDQNKAADAVGEILLSLSYLPTAERLTVVVVKAKNLIWTNDKTTADPFVKVYLLQDGRKMSKKKTAVKRDDPNPVFNEAMIFSVPAIVLQDLSLRVTVAESSSDGRGDNVGHVIIGPSASGMGTTHWNQMLATLRRPVSMWHAVRRN

SEQ ID NO: 66098 - protein, 421 aa, Homo sapiens; identical to SEQ ID NO: 66097

SEQ ID NO: 66099 - protein, 421 aa, Homo sapiens; identical to SEQ ID NO: 66097

SEQ ID NO: 66100 - protein, 426 aa, Homo sapiens
MVLSVPVIALGATLGTATSILALCGVTCLCRHMHPKKGLLPRDQDPDLEKAKPSLLGSAQQFNVKKSTEPVQPRALLKFPDIYGPRPAVTAPEVINYADYSLRSTEEPTAPASPQPPNDSRLKRQVTEELFILPQNGVVEDVCVMETWNPEKAASWNQAPKLHYCLDYDCQKAELFVTRLEAVTSNHDGGCDCYVQGSVANRTGSVEAQTALKKRQLHTTWEEGLVLPLAEEELPTATLTLTLRTCDRFSRHSVAGELRLGLDGTSVPLGAAQWGELKTSAKEPSAGAGEVLLSISYLPAANRLLVVLIKAKNLHSNQSKELLGKDVSVKVTLKHQARKLKKKQTKRAKHKINPVWNEMIMFELPDDLLQASSVELEVLGQDDSGQSCALGHCSLGLHTSGSERSHWEEMLKNPRRQIAMWHQLHL

SEQ ID NO: 66101 - protein, 517 aa, Homo sapiens
MLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPNTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 66102 - protein, 574 aa, Homo sapiens
MAIEGGERTCGVHELICIRKVSPEAVGFLSAVGVFIILMLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPNGLFCCLKHLIGGQVYIIRDTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 66103 - protein, 458 aa, Homo sapiens
MAIEGGERTCGVHELICIRKVSPEAVGFLSAVGVFIILMLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPKMDCSVV

SEQ ID NO: 66104 - protein, 619 aa, Homo sapiens
MASASWRLKVEREPVEYMNLSVLEKIGYFSVARLEYSGTILAHCNFRLLGSNDSSASASQVTGTTVSPEAVGFLSAVGVFIILMLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPNGLFCCLKHLIGGQVYIIRDTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 66105 - protein, 555 aa, Homo sapiens
MAIEGGERTCGVHELICIRKVSPEAVGFLSAVGVFIILMLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPNTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 66106 - protein, 581 aa, Homo sapiens
MAIEGGERTCGVHELICIRKVSPEAVGFLSAVGVFIILMLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPTFHPLLSDGLFCCLKHLIGGQVYIIRDTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 66107 - protein, 517 aa, Homo sapiens; identical to SEQ ID NO: 66101

SEQ ID NO: 66108 - protein, 421 aa, Homo sapiens
MAEQLALVIGGTIGGLLLLLLIGASCCLWRRFCATLTYEELPGTPAMATTAASSGQRDRPCQPHARTQLSRPPAVPFVVPPTLQGRDWVPLHSGEWADAPWDPCPASELLPHTSSGGLGDACMVGAINPELYKFPEDKSETDFPDGCLGRLWFSVEYEQEAERLLVGLIKAQHLQAPSETCSPLVKLYLLPDERRFLQSKTKRKTSNPQFDEHFIFQVSSKTITQRVLKFSVYHVDRQRKHQLLGQVLFPLKNETLVGDCRRVIWRDLEAESLEPPSEFGDLQFCLSYNDYLSRLTVVVLRAKGLRLQEDRGIVSVFVKVSLMNHNKFVKCKKTSAVLGSINPVYNETFSFKADATELDTASLSLTVVQNMEGDKSQQLGRVVVGPYMYTRGRELEHWDEMLSKPKELVKRWHALCRTTEP

SEQ ID NO: 66109 - protein, 474 aa, Homo sapiens
MGVVLSPHPAPSRREPLAPLAPGTRPGWSPAVSGSSRSALRPSTAGPGPGPGTGWGGTAASGRWVPAPAVHCAAPRAAAGHQQHHGPPLCSPDGAPRRFKRRPGSPAPAAQTGETSLREQPHGGPPAVPFVVPPTLQGRDWVPLHSGEWADAPWDPCPASELLPHTSSGGLGDACMVGAINPELYKFPEDKSETDFPDGCLGRLWFSVEYEQEAERLLVGLIKAQHLQAPSETCSPLVKLYLLPDERRFLQSKTKRKTSNPQFDEHFIFQVSSKTITQRVLKFSVYHVDRQRKHQLLGQVLFPLKNETLVGDCRRVIWRDLEAESLEPPSEFGDLQFCLSYNDYLSRLTVVVLRAKGLRLQEDRGIVSVFVKVSLMNHNKFVKCKKTSAVLGSINPVYNETFSFKADATELDTASLSLTVVQNMEGDKSQQLGRVVVGPYMYTRGRELEHWDEMLSKPKELVKRWHALCRTTEP

SEQ ID NO: 66110 - protein, 390 aa, Homo sapiens
MAEQLALVIGGTIGGLLLLLLIGASCCLWRRFCATLTYEELPGTPAMATTAASSGQRDRPCQPHARTQLSRPPAVPFVVPPTLQGRDWVPLHSGEWADAPWDPCPASELLPHTSSGGLGDACMVGAINPELYKFPEDKSETDFPDGCLGRLWFSVEYEQEAERLLVGLIKAQHLQAPSETCSPLVKLYLLPDERRFLQSKTKRKTSNPQFDEHFIFQVSSKTITQRVLKFSVYHVDRQRKHQLLGQVLFPLKNETLVGDCRRVIWRDLEAESLEPPSEFGDLQFCLSYNDYLSRLTVVVLRAKGLRLQEDRGIVSVFVKVSLMNHNKFVKCKKTSAVLGSINPVYNETFSFKADATELDTASLSLTVVQNMEGDKQATTVELFLFHLTSG

SEQ ID NO: 66111 - protein, 180 aa, Homo sapiens
DEHFIFQVSSKTITQRVLKFSVYHVDRQRKHQLLGQVLFPLKNETLVGDCRRVIWRDLEAESLEPPSEFGDLQFCLSYNDYLSRLTVVVLRAKGLRLQEDRGIVSVFVKVSLMNHNKFVKCKKTSAVLGSINPVYNETFSFKADATELDTASLSLTVVQNMEGDKQATTVELFLFHLTSG

SEQ ID NO: 66112 - protein, 260 aa, Homo sapiens
MVGAINPELYKFPEDKSETCSPLVKLYLLPDERRFLQSKTKRKTSNPQFDEHFIFQVSSKTITQRVLKFSVYHVDRQRKHQLLGQVLFPLKNETLVGDCRRVIWRDLEAESLEPPSEFGDLQFCLSYNDYLSRLTVVVLRAKGLRLQEDRGIVSVFVKVSLMNHNKFVKCKKTSAVLGSINPVYNETFSFKADATELDTASLSLTVVQNMEGDKSQQLGRVVVGPYMYTRGRELEHWDEMLSKPKELVKRWHALCRTTEP

SEQ ID NO: 66113 - protein, 348 aa, Homo sapiens
MAEQLALVIGGTIGGLLLLLLIGASCCLWRRFCATLTYEELPGTPAMATTAASSGQRDRPCQPHARTQLSRPPAVPFVVPPTLQGRDWVPLHSGEWADAPWDPCPASELLPHTSSGGLGDACMVGAINPELYKFPEDKSETDFPDGCLGRLWFSVEYEQEAERLLVGLIKAQHLQAPSETCSPLVKLYLLPDERRFLQSKTKRKTSNPQFDEHFIFQVSSKTITQRVLKFSVYHVDRQRKHQLLGQVLFPLKNETLVGDCRRVIWRDLEAESLEPPSEFGDLQFCLSYNDYLSRLTVVVLRAKGLRLQEDRGIVSVFVKVSLMNHNKFAKCKPGPDLGEESRGSLNLK

SEQ ID NO: 66114 - protein, 390 aa, Homo sapiens; identical to SEQ ID NO: 66110

SEQ ID NO: 66115 - protein, 383 aa, Homo sapiens
MVLAMASQDVQNFFQPFSSWISRVYEALQQAGDMLSASLVNISKQDSKLSDKLDQDLDNIQIQETYFEDEEQDNDWSQEDANSLFLEVDHFSCCNSDLQDSAQNSSPSLSQHAKDSCSTMSQWPNWASDDRKLPHVLSSIAEEEHHLEKQRSGLQHGFDSQLPGTLETVNGKKQVNSFGDDEELSTSSDSDEEVIKQFEISVSRSQSFRSVTSEKGKQTGLEQKPKFSRSLLTHGEDGTEVSACEDLDGASQRRYSENLSYGEDDHIPAHSQSPCERGDAKHHGTSHQESSVVQSLRRQSTEGSLEMETAFNSRGFEDSYATDSSSMWSPEANLNLKRKGYLLDVYCLSSPLLFTTSLHRRNRTGPICRCHPGSQSPSQSVVT

SEQ ID NO: 66116 - protein, 645 aa, Homo sapiens
MVLAMASQDVQNFFQPFSSWISRVYEALQQAGDMLSASLVNISKQDSKLSDKLDQDLDNIQIQETYFEDEEQDNDWSQEDANSLFLEVDHFSCCNSDLQDSAQNSSPSLSQHAKDSCSTMSQWPNWASDDRKLPHVLSSIAEEEHHLEKQRSGLQHGFDSQLPGTLETVNGKKQVNSFGDDEELSTSSDSDEEVIKQFEISVSRSQSFRSVTSEKGKQTGLEQKPKFSRSLLTHGEDGTEVSACEDLDGASQRRYSENLSYGEDDHIPAHSQSPCERGDAKHHGTSHQESSVVQSLRRQSTEGSLEMETAFNSRGFEDSYATDSSSMWSPEEQDRTNLQVPSGVSEPISKCGDLDVIFEYRAASQKLTVTIVRAQGLPDKDRSGVNSWQVHVVLLPGKKHRGRTNIQRGPNPVFREKVTFAKLEPRDVAACAVRFRLYAARKMTRERMMGEKLFYLSHLHPEGEMKVTLVLEPRSNISSGGSPLSPSAVSHSDSTSSTQSLSHGGAPELLVGLSYNATTGRLSVEMIKGSHFRNLAVNRAPDTYGKLFLLNSVGQEMSRCKTSIRRGQPNPVYKETFVFQVALFQLSDVTLMISVYNRRTMKRKEMIGWIALGQNSSGEEEQDHWEEMKETKGQQICRWHTLLES

SEQ ID NO: 66117 - protein, 550 aa, Homo sapiens
MPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEASDPEEASQAQEDPGQGDQQVCAEEADPELEPASGGEQEPRPQQAQTKAASQILENGEEAPGPDPSLDRMLSSSSSVSSLNSSTLSGSQMSLSGDAEAVQVRGSVHFALHYEPGAAELRVHVIQCQGLAAARRRRSDPYVKSYLLPDKQSKRKTAVKKRNLNPVFNETLRYSVPQAELQGRVLSLSVWHRESLGRNIFLGEVEVPLDTWDWGSEPTWLPLQPRVPPSPDDLPSRGLLALSLKYVPAGSEGAGLPPSGELHFWVKEARDLLPLRAGSLDTYVQCFVLPDDSQASRQRTRVVRRSLSPVFNHTMVYDGFGPADLRQACAELSLWDHGALANRQLGGTRLSLGTGSSYGLQVPWMDSTPEEKQLWQALLEQPCEWVDGLLPLRTNLAPRT

SEQ ID NO: 66118 - protein, 76 aa, Homo sapiens
MPQRGHPSQEGLWALPSLPMAHGPKPETEGLLDLSFLTEEEQEAIAGVLQRDARLRQLEEGRVSKLRASVADPGQL

SEQ ID NO: 66119 - protein, 354 aa, Homo sapiens
MPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEGPDFPSPSVPLKASDPEEASQAQEDPGQGDQQVCAEEADPELEPASGGEQEPRPQQAQVGGSGPWLLSTSGADSGRGALLPRAASRPRPRALGAGVGKEGAPRHLPPLQTKAASQILENGEEAPGPDPSLDRMLSSSSSVSSLNSSTLSGSQMSLSGDAEAVQVRGSVHFALHYEPGAAELRVHVIQCQGLAAARRRRSDP

SEQ ID NO: 66120 - protein, 201 aa, Homo sapiens
MGTTALLGGVRLSETIPVKRLARGLARVRDGGWGSPQAGEKALGGPLLTSGSHLPSYVKSYLLPDKQSKRKTAVKKRNLNPVFNETLRYSVPQAELQGRVLSLSVWHRESLGRNIFLGEVEVPLDTWDWGSEPTWLPLQPRVPPSPDDLPSRGLLALSLKYVPAGSEGAGLPPSGELHFWVKEARDLLPLRAGSLDTYVQW

SEQ ID NO: 66121 - protein, 360 aa, Homo sapiens
MPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEGPDFPSPSVPLKASDPEEASQAQEDPGQGDQQVCAEEADPELEPASGGEQEPRPQQAQVGGSGPWLLSTSGADSGRGALLPRAASRPRPRALGAGVGKEGAPRHLPPLQTKAASQILENGEEAPGPDPSLDRMLSSSSSVSSLNSSTVRREGGDPGGRGVDPFRCVAPACPSLAAGPTAAAPQPATYDPGLKPPRCPRPRREPCERP

SEQ ID NO: 66122 - protein, 292 aa, Homo sapiens
  MOD_RES (1)..(1): Any amino acid
XPRPQQAQVGGSGPWLLSTSGADSGRGALLPRAASRPRPRALGAGVGKEGAPRHLPPLQTKAASQILENGEEAPGPDPSLDRMLSSSSSVSSLNSSTLSGSQMSLSGDAEAVQVRGSVHFALHYEPGAAELRVHVIQCQGLAAARRRRSDPYVKSYLLPDKQSKRKTAVKKRNLNPVFNETLRYSVPQAELQGRVLSLSVWHRESLGRNIFLGEVEVPLDTWDWGSEPTWLPLQPRVPPSPDDLPSRGLLALSLKYVPAGSEGAGLPPSGELHFWVKEARDLLPLRAGSLDT

SEQ ID NO: 66123 - protein, 562 aa, Homo sapiens
MPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEGPDFPSPSVPLKASDPEEASQAQEDPGQGDQQVCAEEADPELEPASGGEQEPRPQQAQTKAASQILENGEEAPGPDPSLDRMLSSSSSVSSLNSSTLSGSQMSLSGDAEAVQVRGSVHFALHYEPGAAELRVHVIQCQGLAAARRRRSDPYVKSYLLPDKQSKRKTAVKKRNLNPVFNETLRYSVPQAELQGRVLSLSVWHRESLGRNIFLGEVEVPLDTWDWGSEPTWLPLQPRVPPSPDDLPSRGLLALSLKYVPAGSEGAGLPPSGELHFWVKEARDLLPLRAGSLDTYVQCFVLPDDSQASRQRTRVVRRSLSPVFNHTMVYDGFGPADLRQACAELSLWDHGALANRQLGGTRLSLGTGSSYGLQVPWMDSTPEEKQLWQALLEQPCEWVDGLLPLRTNLAPRT

SEQ ID NO: 66124 - protein, 935 aa, Homo sapiens
MIDLSFLTEEEQEAIMKVLQRDAALKRAEEERVRHLPEKIKDDQQLKNMSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKQRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPADELSHCVEPEPSQVPGGSSRDRQQGSEEEPSPVLKTLERSAARKMPSKSLEDISSDSSNQAKVDNQPEELVRSAEDVSTVPTQPDNPFSHPDKLKRMSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 66125 - protein, 1272 aa, Homo sapiens
MDEPNAEQVYNPSQFENLRKFWDLEANSNSKDNDKNITTTSQKNSAPFNRQKHKEFSDIKLSGKNTHEAEVLLSPKKVMAREEMEKLNSKGILQVLPDEITFPLSPLRKYTYQLPGNESSKENVEKNTEGIVTPVFKEEKDYSEQEIQESIIKTNVLSKDCKDTFNDSLQKLLSETSTPAIQPSGGKVHGKQVLEPSVSENRTWPQKTDFADTEEEVKGPEKIINEHVDKTVVHPKVKRNSLTASLDKLLKEATGTSPSPLQAKLAPVITGTNSKLEEGRFFGKGIEQSHNTSADKREILAPFPVRDETFGNTALLKKAESGECQLSTQNLIQMAAEDSHPLDPTSQLSRKGSFGDVASPPQDMLFPQDAHLVPQARVHPSQTEISETVEKVILPPRPVLNDVSAALQKLCGEVWLSYPAGREVGPGEVNPEFPEAVQPVCSPLNPPGVISPWATMDTIVPDRKDFYSSNVVPDKTHEVGSYLAAQMSPSDQTLSSFASIVAQYGKGLPQEVEEIVRETIVQPKSEFLEFSAGLEKLLKEETETFPSKYESDTGNLSPSKLIGSTEEPRRATSECHPEELKETVEKAEAPLITESAFDAGFEKLLKEITEAPPYQPQVSVREETHEKESSQSEQTRFLGTVPHFYRAASQTSEMKDKSNGLESQVNQCDKMLGGDALVTDLLVDFCGSRSGVEIPRTPQLYVAHEIGTIKTVTPPEDRDSESGVAGGQGTLQEPGFGEASEAISVSRNRQPIPLLMNKENSTKTSKVELTLASPYMKQEKEEEKEGFSESDFSDGNTSSNAESWRNPSSSEEEPSPVLKTLERSAARKMPSKSLEDISSDSSNQAKVDNQPEELVRSAEDDEKPDQKPVTNECVPRISTVPTQPDNPFSHPDKLKRMSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 66126 - protein, 1780 aa, Homo sapiens
MINSSLSMLFSYLEKYFYVADELSHCVEPEPSQVPGGSSRDRQQGKPPPLPALKAKTSSRSGPYATEIKKSTDDSIFKVLDWFNRSSYSDDNKSFLQHPRGIESKEKTDSKSQVAVDLVTDDTTLRENGSKTLSPSKIELKPVRSDSPFQAEGDMLVSESCQDNNVNIKSKFMNLSQKGTPKEGPGILQPFESYGTPSQGSKNMDYSQDSKSPGKGNGASPSNSNYSYSVLKESDAENQVPCNTNNIGNLGEEEPKFHAHEENRGHSEVNFDSSTVVKEPGLKDNMNAERKSKVGNTYILKASLEPENIKSTPGVANNGSPWKKPEVQFQQEAGEVPKNQVQREKYKRVSDRISFWEGEKAGAKITHEKPTSSCSQEQPSAKAYQPVKKSQGVSSMDSLSTDQSEYNQAIPKRVVLDEDDQASQLSNSYSSNKSKETKPQIAGPSRYYLSAEQSDKVSLFQNKKNEPIKRSQVADSLPSRRNITLPALQPPSNVGSERHAPLEKDRPLVRESNANFKVMSLKERMDEPNAEQVYNPSQFENLRKFWDLEANSNSKDNDKNITTTSQKNSAPFNRQKHKEFSDIKLSGKNTHEAEVLLSPKKVMAREEMEKLNSKGILQVLPDEITFPLSPLRKYTYQLPGNESSKENVEKNTEGIVTPVFKEEKDYSEQEIQESIIKTNVLSKDCKDTFNDSLQKLLSETSTPAIQPSGGKVHGKQVLEPSVSENRTWPQKTDFADTEEEVKGPEKIINEHVDKTVVHPKVKRNSLTASLDKLLKEATGTSPSPLQAKLAPVITGTNSKLEEGRFFGKGIEQSHNTSADKREILAPFPVRDETFGNTALLKKAESGECQLSTQNLIQMAAEDSHPLDPTSQLSRKGSFGDVASPPQDMLFPQDAHLVPQARVHPSQTEISETVEKVILPPRPVLNDVSAALQKLCGEVWLSYPAGREVGPGEVNPEFPEAVQPVCSPLNPPGVISPWATMDTIVPDRKDFYSSNVVPDKTHEVGSYLAAQMSPSDQTLSSFASIVAQYGKGLPQEVEEIVRETIVQPKSEFLEFSAGLEKLLKEETETFPSKYESDTGNLSPSKLIGSTEEPRRATSECHPEELKETVEKAEAPLITESAFDAGFEKLLKEITEAPPYQPQVSVREETHEKESSQSEQTRFLGTVPHFYRAASQTSEMKDKSNGLESQVNQCDKMLGGDALVTDLLVDFCGSRSGVEIPRTPQLYVAHEIGTIKTVTPPEDRDSESGVAGGQGTLQEPGFGEASEAISVSRNRQPIPLLMNKENSTKTSKVELTLASPYMKQEKEEEKEGFSESDFSDGNTSSNAESWRNPSSSEEEPSPVLKTLERSAARKMPSKSLEDISSDSSNQAKVDNQPEELVRSAEDVSTVPTQPDNPFSHPDKLKRMSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 66127 - protein, 365 aa, Homo sapiens
MSDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 66128 - protein, 910 aa, Homo sapiens
MIDLSFLTEEEQEAIMKVLQRDAALKRAEEERVRHLPEKIKDDQQLKNMSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPADELSHCVEPEPSQVPGGSSRDRQQGSEEEPSPVLKTLERSAARKMPSKSLEDISSDSSNQAKVDNQPEELVRSAEDDEKPDQKPVTNECVPRISTVPTQPDNPFSHPDKLKRMSKSVPAFLQDEVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 66129 - protein, 910 aa, Homo sapiens; identical to SEQ ID NO: 66128

SEQ ID NO: 66130 - protein, 63 aa, Homo sapiens
MSKSVPAFLQDESDDRETDTASESSYQLSRHKKSPSSLTNLSSSSGMTSLSSVSGSVMSVYSG

SEQ ID NO: 66131 - protein, 1256 aa, Homo sapiens
MDEPNAEQVYNPSQFENLRKFWDLEANSNSKDNDKNITTTSQKNSAPFNRQKHKEFSDIKLSGKNTHEAEVLLSPKKVMAREEMEKLNSKGILQVLPDEITFPLSPLRKYTYQLPGNESSKENVEKNTEGIVTPVFKEEKDYSEQEIQESIIKTNVLSKDCKDTFNDSLQKLLSETSTPAIQPSGGKVHGKQVLEPSVSENRTWPQKTDFADTEEEVKGPEKIINEHVDKTVVHPKVKRNSLTASLDKLLKEATGTSPSPLQAKLAPVITGTNSKLEEGRFFGKGIEQSHNTSADKREILAPFPVRDETFGNTALLKKAESGECQLSTQNLIQMAAEDSHPLDPTSQLSRKGSFGDVASPPQDMLFPQDAHLVPQARVHPSQTEISETVEKVILPPRPVLNDVSAALQKLCGEVWLSYPAGREVGPGEVNPEFPEAVQPVCSPLNPPGVISPWATMDTIVPDRKDFYSSNVVPDKTHEVGSYLAAQMSPSDQTLSSFASIVAQYGKGLPQEVEEIVRETIVQPKSEFLEFSAGLEKLLKEETETFPSKYESDTGNLSPSKLIGSTEEPRRATSECHPEELKETVEKAEAPLITESAFDAGFEKLLKEITEAPPYQPQVSVREETHEKESSQSEQTRFLGTVPHFYRAASQTSEMKDKSNGLESQVNQCDKMLGGDALVTDLLVDFCGSRSGVEIPRTPQLYVAHEIGTIKTVTPPEDRDSESGVAGGQGTLQEPGFGEASEAISVSRNRQPIPLLMNKENSTKTSKVELTLASPYMKQEKEEEKEGFSESDFSDGNTSSNAESWRNPSSSEEEPSPVLKTLERSAARKMPSKSLEDISSDSSNQAKVDNQPEELVRSAEDVSTVPTQPDNPFSHPDKLKRMSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 66132 - protein, 376 aa, Homo sapiens
MSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 66133 - protein, 103 aa, Homo sapiens
MSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVK

SEQ ID NO: 66134 - protein, 902 aa, Homo sapiens
MSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPADELSHCVEPEPSQVPGGSSRDRQQGSEEEPSPVLKTLERSAARKMPSKSLEDISSDSSNQAKVDNQPEELVRSAEDDEKPDQKPVTNECVPRISTVPTQPDNPFSHPDKLKRMSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 66135 - protein, 160 aa, Homo sapiens
MSKSVPAFLQDEVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRK

SEQ ID NO: 66136 - protein, 934 aa, Homo sapiens
MIDLSFLTEEEQEAIMKVLQRDAALKRAEEERVRHLPEKIKDDQQLKNMSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPADELSHCVEPEPSQVPGGSSRDRQQGSEEEPSPVLKTLERSAARKMPSKSLEDISSDSSNQAKVDNQPEELVRSAEDVSTVPTQPDNPFSHPDKLKRMSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 66137 - protein, 155 aa, Homo sapiens
MSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQK

SEQ ID NO: 66138 - protein, 376 aa, Homo sapiens; identical to SEQ ID NO: 66132

SEQ ID NO: 66139 - protein, 651 aa, Homo sapiens
ETVEKAEAPLITESAFDAGFEKLLKEITEAPPYQPQVSVREETHEKESSQSEQTRFLGTVPHFYRAASQTSEMKDKSNGLESQVNQCDKMLGGDALVTDLLVDFCGSRSGVEIPRTPQLYVAHEIGTIKTVTPPEDRDSESGVAGGQGTLQEPGFGEASEAISVSRNRQPIPLLMNKENSTKTSKVELTLASPYMKQEKEEEKEGFSESDFSDGNTSSNAESWRNPSSSEEEPSPVLKTLERSAARKMPSKSLEDISSDSSNQAKVDNQPEELVRSAEDDEKPDQKPVTNECVPRISTVPTQPDNPFSHPDKLKRMSKSVPAFLQDEVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 66140 - protein, 70 aa, Homo sapiens
MSKSVPAFLQDESDDRETDTASESSYQLSRHKKSPSSLTNLSSSSGMTSLSSVSGSVMSVYSGDFGNLEV

SEQ ID NO: 66141 - protein, 336 aa, Homo sapiens
MSKSVPAFLQDEVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 66142 - protein, 671 aa, Homo sapiens
MSELLDLSFLSEEEKDLILSVLQRDEEVRKADEKRIRRLKNELLEIKRKGAKRGSQHYSDRTCARCQESLGRLSPKTNTCRGCNHLVCRDCRIQESNGTWRCKVCAKEIELKKATGDWFYDQKVNRFAYRTGSEIIRMSLRHKPAVSKRETVGQSLLHQTQMGDIWPGRKIIQERQKEPSVLFEVPKLKSGKSALEAESESLDSFTADSDSTSRRDSLDKSGLFPEWKKMSAPKSQVEKETQPGGQNVVFVDEGEMIFKKNTRKILRPSEYTKSVIDLRPEDVVHESGSLGDRSKSVPGLNVDMEEEEEEEDIDHLVKLHRQKLARSSMQSGSSMSTIGSMMSIYSEAGDFGNIFVTGRIAFSLKYEQQTQSLVVHVKECHQLAYADEAKKRSNPYVKTYLLPDKSRQGKRKTSIKRDTINPLYDETLRYEIPESLLAQRTLQFSVWHHGRFGRNTFLGEAEIQMDSWKLDKKLDHCLPLHGKISAESPTGLPSHKGELVVSLKYIPASKTPVGGDRKKSKGGEGGELQVWIKEAKNLTAAKAGGTSDSFVKGYLLPMRNKASKRKTPVMKKTLNPHYNHTFVYNGVRLEDLQHMCLELTVWDREPLASNDFLGGVRLGVGTGISNGEVVDWMDSTGEEVSLWQKMRQYPGSWAEGTLQLRSSMAKQKLGL

SEQ ID NO: 66143 - protein, 671 aa, Homo sapiens; identical to SEQ ID NO: 66142

SEQ ID NO: 66144 - protein, 349 aa, Homo sapiens
MSELLDLSFLSEEEKDLILSVLQRDEEVRKADEKRIRRLKNELLEIKRKGAKRGSQHYSDRTCARCQESLGRLSPKTNTCRGCNHLVCRDCRIQESNGTWRCKVCAKEIELKKATGDWFYDQKVNRFAYRTGSEIIRMSLRHKPAVSKRETVGQSLLHQTQMGDIWPGRKIIQERQKEPSVLFEVPKLKSGKSALEAESESLDSFTADSDSTSRRDSLDKSGLFPEWKKMSAPKSQVEKETQPGGQNVVFVDEGEMIFKKNTRKILRPSEYTKSVIDLRPEDVVHESGSLGDRSKSVPGLNVDMEEEEEEEDIDHLVKLHRQKLARSSMQSGSSMVSSIRSVVTGMLGY

SEQ ID NO: 66145 - protein, 671 aa, Homo sapiens; identical to SEQ ID NO: 66142

SEQ ID NO: 66146 - protein, 673 aa, Homo sapiens
MSELLDLSFLSEEEKDLILSVLQRDEEVRKADEKRIRRLKNELLEIKRKGAKRGSQHYSDRTCARCQESLGRLSPKTNTCRGCNHLVCRDCRIQESNGTWRCKVCAKEIELKKATGDWFYDQKVNRFAYRTGSEIIRMSLRHKPAVSKRETVGQSLLHQTQMGDIWPGRKIIQERQKEPSSVLFEVPKLKSGKSALEAESESLDSFTADSDSTSRRDSLDKSGLFPEWKKMSAPKSQVEKETQPGGQNVVFVDEGEMIFKKNTRKILRPSEYTKSVIDLRPEDVVHESGSLGDRSKSVPGLNVDMVEEEEEEEDIDHLVKLHRQKLARSSMQSGSSMSTIGSMMSIYSEAGDFGNIFVTGRIAFSLKYEQQTQSLVVHVKECHQLAYADEAKKRSNPYVKTYLLPDKSRQGKRKTSIKRDTINPLYDETLRYEIPESLLAQRTLQFSVWHHGRFGRNTFLGEAEIQMDSWKLDKKLDHCLPLHGKISAESPTGLPSHKGELVVSLKYIPASKTPVGGDRKKSKGGEGGELQVWIKEAKNLTAAKAGGTSDSFVKGYLLPMRNKASKRKTPVMKKTLNPHYNHTFVYNGVRLEDLQHMCLELTVWDREPLASNDFLGGVRLGVGTGISNGEVVDWMDSTGEEVSLWQKMRQYPGSWAEGTLQLRSSMAKQKLGL

SEQ ID NO: 66147 - protein, 671 aa, Homo sapiens; identical to SEQ ID NO: 66142

SEQ ID NO: 66148 - protein, 310 aa, Homo sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHLASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 66149 - protein, 310 aa, Homo sapiens; identical to SEQ ID NO: 66148

SEQ ID NO: 66150 - protein, 201 aa, Homo sapiens
MRRAWILLTLGLVACVSAESRAELTSDKDMYLDNSSIEEASGVYPIDDDDYASASGSGADEDVESPELTTSRPLPKILLTSAAPKVETTTLNIQNKIPAQTKSPEETDKEKVHLSDSERKMDPAEEDTNVYTEKHSDSLFKRTEVLAAVIAGGVIGFLFAIFLILLLVYRMRKKDEGSYDLGERKPSSAAYQKAPTKEFYA

SEQ ID NO: 66151 - protein, 165 aa, Homo sapiens
MRRAWILLTLGLVACVSAESVRADEDVESPELTTSRPLPKILLTSAAPKVETTTLNIQNKIPAQTKSPEETDKEKVHLSDSERKMDPAEEDTNVYTEKHSDSLFKRTEVLAAVIAGGVIGFLFAIFLILLLVYRMRKKDEGSYDLGERKPSSAAYQKAPTKEFYA

SEQ ID NO: 66152 - protein, 172 aa, Homo sapiens
MYLDNSSIEEASGVYPIDDDDYASASGSGADEDVESPELTTSRPLPKILLTSAAPKVETTTLNIQNKIPAQTKSPEETDKEKVHLSDSERKMDPAEEDTNVYTEKHSDSLFKRTEVLAAVIAGGVIGFLFAIFLILLLVYRMRKKDEGSYDLGERKPSSAAYQKAPTKEFYA

SEQ ID NO: 66153 - protein, 172 aa, Homo sapiens; identical to SEQ ID NO: 66152

SEQ ID NO: 66154 - protein, 201 aa, Homo sapiens; identical to SEQ ID NO: 66150

SEQ ID NO: 66155 - protein, 191 aa, Homo sapiens
MRVACVSAESRAELTSDKDMYLDNSSIEEASGVYPIDDDDYASASGSGADEDVESPELTTSRPLPKILLTSAAPKVETTTLNIQNKIPAQTKSPEETDKEKVHLSDSERKMDPAEEDTNVYTEKHSDSLFKRTEVLAAVIAGGVIGFLFAIFLILLLVYRMRKKDEGSYDLGERKPSSAAYQKAPTKEFYA

SEQ ID NO: 66156 - protein, 384 aa, Homo sapiens
MAIAYLGSSCPSQPPSSLALSLSPTPSDFEQESGIETAMRFSPDVALAVSTTPAVLPTTNIQPVGTPFEELPSERPTLEPATSPLVVTEVPEEPSQRATTVSTTMATTAATSTGDPTVATVPATVATATPSTPAAPPFTATTAVIRTTGVRRLLPLPLTTVATARATTPEAPSPPTTAAVLDTEAPTPRLVSTATSRPRALPRPATTQEPDIPERSTLPLGTTAPGPTEVAQTPTPETFLTTIRDEPEVPVSGGPSGDFELPEEETTQPDTANEVVAVGGAAAKASSPPGTLPKGARPGPGLLDNAIDSGSSAAQLPQKSILERKEVLVAVIVGGVVGALFAAFLVTLLIYRMKKKDEGSYTLEEPKQASVTYQKPDKQEEFYA

SEQ ID NO: 66157 - protein, 442 aa, Homo sapiens
MKPGPPHRAGAAHGAGAGAGAAAGPGARGLLLPPLLLLLLAGRAAGAQRWRSENFERPVDLEGSGDDDSFPDDELDDLYSGSGSGYFEQESGIETAMRFSPDVALAVSTTPAVLPTTNIQPVGTPFEELPSERPTLEPATSPLVVTEVPEEPSQRATTVSTTMATTAATSTGDPTVATVPATVATATPSTPAAPPFTATTAVIRTTGVRRLLPLPLTTVATARATTPEAPSPPTTAAVLDTEAPTPRLVSTATSRPRALPRPATTQEPDIPERSTLPLGTTAPGPTEVAQTPTPETFLTTIRDEPEVPVSGGPSGDFELPEEETTQPDTANEVVAVGGAAAKASSPPGTLPKGARPGPGLLDNAIDSGSSAAQLPQKSILERKEVLVAVIVGGVVGALFAAFLVTLLIYRMKKKDEGSYTLEEPKQASVTYQKPDKQEEFYA

SEQ ID NO: 66158 - protein, 198 aa, Homo sapiens
MAPARLFALLLFFVGGVAESIRETEVIDPQDLLEGRYFSGALPDDEDVVGPGQESDDFELSGSGDLDDLEDSMIGPEVVHPLVPLDNHIPERAGSGSQVPTEPKKLEENEVIPKRISPVEESEDVSNKVSMSSTVQGSNIFERTEVLAALIVGGIVGILFAVFLILLLMYRMKKKDEGSYDLGKKPIYKKAPTNEFYA

SEQ ID NO: 66159 - protein, 126 aa, Homo sapiens
MIGPEVVHPLVPLDNHIPERAGSGSQVPTEPKKLEENEVIPKRISPVEESEDVSNKVSMSSTVQGSNIFERTEVLAALIVGGIVGILFAVFLILLLMYRMKKKDEGSYDLGKKPIYKKAPTNEFYA

SEQ ID NO: 66160 - protein, 616 aa, Homo sapiens
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSCLRSWFQRQQTCPTCRMDVLRASLPAQSPPPPEPADQGPPPAPHPPPLLPQPPNFPQGLLPPFPPGMFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 66161 - protein, 565 aa, Homo sapiens
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSCLRSWFQRQQTCPTCRMDVLRASLPAQSPPPPEPADQGPPPAPHPPPLLPQPPNFPQGLLPPFPPGMFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 66162 - protein, 617 aa, Homo sapiens
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSCLRSWFQRQQTCPTCRMDVLRASLPAQSPPPPEPADQGPPPAPHPPPLLPQPPNFPQGLLPPFPPGMFPLWPPMGPFPPVPPPPSSGEAVAPPSTSAAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 66163 - protein, 629 aa, Homo sapiens
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSCLRSWFQRQQTCPTCRMDVLRASLPAQSPPPPEPADQGPPPAPHPPPLLPQPPNFPQGLLPPFPPGMFPLWPPMGPFPPVPPPPSSGEAVAPPSTSAAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPGLPLQSTPLRRLPLQLLLLPPPPASLAQRPRPQPQEPPHQPLKWKGLQLLSQWAQRRCLRMESPMQQSSAGAACRSWSLLLPTDTAPAQPQPLLF

SEQ ID NO: 66164 - protein, 616 aa, Homo sapiens; identical to SEQ ID NO: 66160

SEQ ID NO: 66165 - protein, 396 aa, Homo sapiens
MSVAFASARPRGKGEVTQQTIQKMLDENHHLIQCILEYQSKGKTAECTQYQQILHRNLVYLATIADSNQNMQSLLPAPPTQNMNLGPGALTQSGSSQGLHSQGSLSDAISTGLPPSSLLQGQIGNGPSHVSMQQTAPNTLPTTSMSISGPGYSHAGPASQGVPMQGQGTIGNYVSRTNINMQSNPVSMMQQQAATSHYSSAQGGSQHYQGQSSIAMMGQGSQGSSMMGQRPMAPYRPSQQGSSQQYLGQEEYYGEQYSHSQGAAEPMGQQYYPDGHGDYAYQQSSYTEQSYDRSFEESTQHYYEGGNSQYSQQQAGYQQGAAQQQTYSQQQYPSQQSYPGQQQGYGSAQGAPSQYPGYQQGQGQQYGSYRAPQTAPSAQQQRPYGYEQGQYGNYQQ

SEQ ID NO: 66166 - protein, 399 aa, Homo sapiens
MQSLSTEARYVPRVPQHRDQISPRSPQHGGQICPRSPLHRGQICPRSPPARRYQQILHRNLVYLATIADSNQNMQSLLPAPPTQNMNLGPGALTQSGSSQGLHSQGSLSDAISTGLPPSSLLQGQIGNGPSHVSMQQTAPNTLPTTSMSISGPGYSHAGPASQGVPMQGQGTIGNYVSRTNINMQSNPVSMMQQQAATSHYSSAQGGSQHYQGQSSIAMMGQGSQGSSMMGQRPMAPYRPSQQGSSQQYLGQEEYYGEQYSHSQGAAEPMGQQYYPDGHGDYAYQQSSYTEQSYDRSFEESTQHYYEGGNSQYSQQQAGYQQGAAQQQTYSQQQYPSQQSYPGQQQGYGSAQGAPSQYPGYQQGQGQQYGSYRAPQTAPSAQQQRPYGYEQGQYGNYQQ

SEQ ID NO: 66167 - protein, 396 aa, Homo sapiens; identical to SEQ ID NO: 66165

SEQ ID NO: 66168 - protein, 128 aa, Homo sapiens
MQSLSTEARYVPRVPQHRDQISPRSPQHGGQICPRSPLHRGQICPRSPPARRYQQILHRNLVYLATIADSNQNMQSLLPAPPTQNMNLGPGALTQSGSSQGLHSQGSLSDAISTGLPPSSLLQGQIGN

SEQ ID NO: 66169 - protein, 77 aa, Homo sapiens
MSVAFVPDWLRGKAEVNQETIQRLLEENDQLIRCIVEYQNKGRGNECVQYQHVLHRNLIYLATIADASPTSTSKAME

SEQ ID NO: 66170 - protein, 77 aa, Homo sapiens; identical to SEQ ID NO: 66169

SEQ ID NO: 66171 - protein, 387 aa, Homo sapiens
MSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGNSQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 66172 - protein, 418 aa, Homo sapiens
MSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 66173 - protein, 421 aa, Homo sapiens
GGNMSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 66174 - protein, 132 aa, Homo sapiens
MNQQYYPDGHNDYGYQQPSYPEQGYDRPYEDSSQHYYEGGNSQYGQQQDAYQGPPPQQGYPPQQQQYPGQQGYPGQQQGYGPSQGGPGPQYPNYPQGQGQQYGGYRPTQPGPPQPPQQRPYGYDQNSRWTVC

SEQ ID NO: 66175 - protein, 336 aa, Homo sapiens
MPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 66176 - protein, 395 aa, Homo sapiens
MLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 66177 - protein, 335 aa, Homo sapiens [sequence omitted]

SEQ ID NO: 66178 - protein, 335 aa, Homo sapiens [sequence omitted]

SEQ ID NO: 66179 - protein, 188 aa, Homo sapiens
MNGDDTFAKRPRDDAKASEKRSKAFDDIATYFSKKEWKKMKYSEKISYVYMKRNYKAMTKLGFKVTLPPFMCNKQATDFQGNDFDNDHNRRIQVEHPQMTFGRLHRIIPKIMPKKPAEDENDSKGVSEASGPQNDGKQLHPPGKANISEKINKRSGPKRGKHAWTHRLRERKQLVIYEEISDPEEDDE

SEQ ID NO: 66180 - protein, 223 aa, Homo sapiens
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGNREAQEKEERRGTAHRWSSQNTHNIGRFSLSTSMGAVHGTPKTITHNRDPKGGNMPGPTDCVRENSW

SEQ ID NO: 66181 - protein, 188 aa, Homo sapiens
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGPKRGEHAWTHRLRERKQLVIYEEISDPEEDDE

SEQ ID NO: 66182 - protein, 188 aa, Homo sapiens
MNGDDTFARRPTVGAQIPEKIQKAFDDIAKYFSKEEWEKMKVSEKIVYVYMKRKYEAMTKLGFKAILPSFMRNKRVTDFQGNDFDNDPNRGNQVQRPQMTFGRLQGIFPKIMPKKPAEEGNVSKEVPEASGPQNDGKQLCPPGKPTTSEKINMISGPKRGEHAWTHRLRERKQLVIYEEISDPEEDDE

SEQ ID NO: 66183 - protein, 170 aa, Homo sapiens
MNGDDTFARRPTVGAQIPEKIQKAFDDIAKYFSKEEWEKMKVSEKIVYVYMKRKYEAMTKLGFKAILPSFMRNKRVTDFQGNDFDNDPNRGNQVQRPQMTFGRLQGIFPKIMPKKPAEEGNVSKEVPEASGPQNDGKQLCPPGKPTTSEKINMISGVLQRYCRFGSRPLQ

SEQ ID NO: 66184 - protein, 100 aa, Homo sapiens
MYSLSVQRPQMTFGRLQGIFPKIMPKKPAEEGNVSKEVPEASGPQNDGKQLCPPGKPTTSEKINMISGPKRGEHAWTHRLRERKQLVIYEEISDPEEDDE

SEQ ID NO: 66185 - protein, 153 aa, Homo sapiens
MNGDDAFARRPRDDAQISEKLRKAFDDIAKYFSKKEWEKMKSSEKIVYVYMKLNYEVMTKLGFKVTLPPFMRSKRAADFHGNDFGNDRNHRNQVERPQMTFGSLQRIFPKDPKGGNMPGPTDCVRESSWWFMKRSATLRKMTSNSPRGYDTCP

SEQ ID NO: 66186 - protein, 188 aa, Homo sapiens
MNGDDAFARRPRDDAQISEKLRKAFDDIAKYFSKKEWEKMKSSEKIVYVYMKLNYEVMTKLGFKVTLPPFMRSKRAADFHGNDFGNDRNHRNQVERPQMTFGSLQRIFPKIMPKKPAEEENGLKEVPEASGPQNDGKQLCPPGNPSTLEKINKTSGPKRGKHAWTHRLRERKQLVVYEEISDPEEDDE

SEQ ID NO: 66187 - protein, 663 aa, Homo sapiens
MGPLRESKKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 66188 - protein, 660 aa, Homo sapiens
MSNFEKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 66189 - protein, 544 aa, Homo sapiens
MVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 66190 - protein, 663 aa, Homo sapiens; identical to SEQ ID NO: 66187

SEQ ID NO: 66191 - protein, 662 aa, Homo sapiens
MGPLRESKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 66192 - protein, 663 aa, Homo sapiens; identical to SEQ ID NO: 66187

SEQ ID NO: 66193 - protein, 663 aa, Homo sapiens; identical to SEQ ID NO: 66187

SEQ ID NO: 66194 - protein, 663 aa, Homo sapiens; identical to SEQ ID NO: 66187

SEQ ID NO: 66195 - protein, 662 aa, Homo sapiens; identical to SEQ ID NO: 66191

SEQ ID NO: 66196 - protein, 137 aa, Homo sapiens
MGPLRESKKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKS

SEQ ID NO: 66197 - protein, 76 aa, Homo sapiens
MGPLRESKKEHRVQHHDKEISRSRIPRLILRPHMPQQQHKVSPASESPFSEEESREFNPSSSGRSARTVSSNSFCS

SEQ ID NO: 66198 - protein, 73 aa, Homo sapiens
MGPLRESKKEHRVQHHDKEISRSRIPRLILRPHMPQQQHKVSPASESPFSEEESREFNPSSSGRSARTVSSNS

SEQ ID NO: 66199 - protein, 125 aa, Homo sapiens
MVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIM

SEQ ID NO: 66200 - protein, 544 aa, Homo sapiens; identical to SEQ ID NO: 66189

SEQ ID NO: 66201 - protein, 80 aa, Homo sapiens
MVGEGSIQSSRYKKESKSGLVKPGSEADFSSSSSTGSISAPEVHMSTAGSKRSSSSRNRGPHGRSNGASSHKPGSSPSSP

SEQ ID NO: 66202 - protein, 662 aa, Homo sapiens; identical to SEQ ID NO: 66191

SEQ ID NO: 66203 - protein, 95 aa, Homo sapiens
MGPLRESKKEHRVQHHDKEISRSRIPRLILRPHMPQQQHKVSPASESPFSEEESREFNPSSSGRSARTVSSNSFCSDDTGCPSSQSVSPVKTPSD

SEQ ID NO: 66204 - protein, 204 aa, Homo sapiens
MGPLRESKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLL

SEQ ID NO: 66205 - protein, 35 aa, Homo sapiens
MVGEGSIQSSRYKKESKSGLVKPGSEADFSSSSST

SEQ ID NO: 66206 - protein, 34 aa, Homo sapiens
MVGEGSIQSSRYKKESKSGLVKPGSEADFSSSSS

SEQ ID NO: 66207 - protein, 80 aa, Homo sapiens; identical to SEQ ID NO: 66201

SEQ ID NO: 66208 - protein, 595 aa, Homo sapiens
MGPFWARKDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 66209 - protein, 544 aa, Homo sapiens; identical to SEQ ID NO: 66189

SEQ ID NO: 66210 - protein, 663 aa, Homo sapiens; identical to SEQ ID NO: 66187

SEQ ID NO: 66211 - protein, 162 aa, Homo sapiens
MGPLRESKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVH

SEQ ID NO: 66212 - protein, 662 aa, Homo sapiens; identical to SEQ ID NO: 66191

SEQ ID NO: 66213 - protein, 104 aa, Homo sapiens
MGPLRESKEHRVQHHDKEISRSRIPRLILRPHMPQQQHKVSPASESPFSEEESREFNPSSSGRSARTVSSNSFCSDDTGCPSSQSVSPVKTPSDAGNSPIGFCP

SEQ ID NO: 66214 - protein, 151 aa, Homo sapiens
MGPLRESKKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSS

SEQ ID NO: 66215 - protein, 76 aa, Homo sapiens; identical to SEQ ID NO: 66197

SEQ ID NO: 66216 - protein, 538 aa, Homo sapiens
MPGSGPSERMTWPGPALSAGPPTRPLSSAPGIPPIPPLTRTHSLMAMSLPGSRRTSAGSRRRTSPPVSVRDAYGTSSLSSSSNSGSYKGSDSSPTPRRSMKYTLCSDNHGIKPPTPEQYLTPLQQKEVCIRHLKARLKDTQDRLQDRDTEIDDLKTQLSRMQEDWIEEECHRVEAQLALKEARKEIKQLKQVIDTVKNNLIDKDKGLQKYFVDINIQNKKLETLLHSMEVAQNGMAKEDGTGESAGGSPARSLTRSSTYTKLSDPAVCGDRQPGDPSSGSAEDGADSGFAAADDTLSRTDALEASSLLSSGVDCGTEETSLHSSFGLGPRFPASNTYEKLLCGMEAGVQASCMQERAIQTDFVQYQPDLDTILEKVTQAQVCGTDPESGDRCPELDAHPSGPRDPNSAVVVTVGDELEAPEPITRGPTPQRPGANPNPGQSVSVVCPMEEEEEAAVAEKEPKSYWSRHYIVDLLAVVVPAVPTVAWLCRSQRRQGQPIYNISSLLRGCCTVALHSIRRISCRSLSQPSPSPAGGGSQL

SEQ ID NO: 66217 - protein, 494 aa, Homo sapiens
MAMSLPGSRRTSAGSRRRTSPPVSVRDAYGTSSLSSSSNSGSYKGSDSSPTPRRSMKYTLCSDNHGIKPPTPEQYLTPLQQKEVCIRHLKARLKDTQDRLQDRDTEIDDLKTQLSRMQEDWIEEECHRVEAQLALKEARKEIKQLKQVIDTVKNNLIDKDKGLQKYFVDINIQNKKLETLLHSMEVAQNGMAKEDGTGESAGGSPARSLTRSSTYTKLSDPAVCGDRQPGDPSSGSAEDGADSGFAAADDTLSRTDALEASSLLSSGVDCGTEETSLHSSFGLGPRFPASNTYEKLLCGMEAGVQASCMQERAIQTDFVQYQPDLDTILEKVTQAQVCGTDPESGDRCPELDAHPSGPRDPNSAVVVTVGDELEAPEPITRGPTPQRPGANPNPGQSVSVVCPMEEEEEAAVAEKEPKSYWSRHYIVDLLAVVVPAVPTVAWLCRSQRRQGQPIYNISSLLRGCCTVALHSIRRISCRSLSQPSPSPAGGGSQL

SEQ ID NO: 66218 - protein, 287 aa, Homo sapiens
MKDRLAELLDLSKQYDQQFPDGDDEFDSPHEDIVFETDHILESLYRDIRDIQDENQLLVADVKRLGKQNARFLTSMRRLSSIKRDTNSIAKAIKARGEVIHCKLRAMKELSEAAEAQHGPHSAVARISRAQYNALTLTFQRAMHDYNQAEMKQRDNCKIRIQRQLEIMGKEVSGDQIEDMFEQGKWDVFSENLLADVKGARAALNEIESRHRELLRLESRIRDVHELFLQMAVLVEKQADTLNVIELNVQKTVDYTGQAKAQVRKAVQYEEKNPCRTLCCFCCPCLK

SEQ ID NO: 66219 - protein, 204 aa, Homo sapiens
MALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDL

SEQ ID NO: 66220 - protein, 308 aa, Homo sapiens
MATRRLTDAFLLLRNNSIQNRQLLAEQELDELADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 66221 - protein, 321 aa, Homo sapiens
MATRRLTDAFLLLRNNSIQNRQLLAEQVSSHITSSPLHSRSIAALADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 66222 - protein, 251 aa, Homo sapiens
MALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLV

SEQ ID NO: 66223 - protein, 308 aa, Homo sapiens
MATRRLTDAFLLLRNNSIQNRQLLAEQQLSKLADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 66224 - protein, 325 aa, Homo sapiens
MATRRLTDAFLLLRNNSIQNRQLLAEQVSSHITSSPLHSRSIAAALDELADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 66225 - protein, 304 aa, Homo sapiens
MATRRLTDAFLLLRNNSIQNRQLLAEQLADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 66226 - protein, 272 aa, Homo sapiens
MALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 66227 - protein, 325 aa, Homo sapiens
MATRRLTDAFLLLRNNSIQNRQLLAEQVSSHITSSPLHSRSIAAELDELADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 66228 - protein, 121 aa, Homo sapiens
MALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELST

SEQ ID NO: 66229 - protein, 139 aa, Homo sapiens
MKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 66230 - protein, 219 aa, Homo sapiens
GISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGTVLDRIDYNVEQSCIKTEDGLKQLHKAEQYQKKNRKMLVILILFVIIIVLIVVLVGVKSR

SEQ ID NO: 66231 - protein, 122 aa, Homo sapiens
MALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTS

SEQ ID NO: 66232 - protein, 202 aa, Homo sapiens
MATRRLTDAFLLLRNNSIQNRQLLAEQELDELADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRRTS

SEQ ID NO: 66233 - protein, 302 aa, Homo sapiens
MSEDEEKVKLRRLEPAIQKFIKIVIPTDLERLRKHQINIEKYQRCRIWDKLHEEHINAGRTVQQLRSNIREIEKLCLKVRKDDLVLLKRMIDPVKEEASAATAEFLQLHLESVEELKKQFNDEETLLQPPLTRSMTVGGAFHTTEAEASSQSLTQIYALPEIPQDQNAAESWETLEADLIELSQLVTDFSLLVNSQQEKIDSIADHVNSAAVNVEEGTKNLGKAAKYKLAALPVAGALIGGMVGGPIGLLAGFKVAGIAAALGGGVLGFTGGKLIQRKKQKMMEKLTSSCPDLPSQTDKKCS

SEQ ID NO: 66234 - protein, 302 aa, Homo sapiens; identical to SEQ ID NO: 66233

SEQ ID NO: 66235 - protein, 41 aa, Homo sapiens
MSEDEEKVKLRRLEPAIQKFIKIVIPTDLERLRKHQINIEK

SEQ ID NO: 66236 - protein, 41 aa, Homo sapiens; identical to SEQ ID NO: 66235

SEQ ID NO: 66237 - protein, 302 aa, Homo sapiens; identical to SEQ ID NO: 66233

SEQ ID NO: 66238 - protein, 288 aa, Homo sapiens
MKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQGEMIDRIEYNVEHAVDYVERAVSDTKKAVKYQSKARRKKIMIIICCVILGIVIASTVGGIFA

SEQ ID NO: 66239 - protein, 260 aa, Homo sapiens
MKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQPQGAFLKSCPEPQPNPEEGALWSSGAPGPAGRDD

SEQ ID NO: 66240 - protein, 171 aa, Homo sapiens
MKDRTQELRTAKDSDDDDDVAVTVDRDRFMDEFFEQVEVMSEYNATQSDYRERCKGRIQRQLEITGRTTTSEELEDMLESGNPAIFASGIIMDSSISKQALSEIETRHSEIIKLEIEYNVEHAVDYVERAVSDTKKAVKYQSKARRKKIMIIICCVILGIVIASTVGGIFA

SEQ ID NO: 66241 - protein, 251 aa, Homo sapiens
MKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQTMWRGPCLTPRRPSSTRARRAGRKS

SEQ ID NO: 66242 - protein, 288 aa, Homo sapiens
MKDRTQELRSAKDSDDEEEVVHVDRDHFMDEFFEQVEEIRGCIEKLSEDVEQVKKQHSAILAAPNPDEKTKQELEDLTADIKKTANKVRSKLKAIEQSIEQEEGLNRSSADLRIRKTQHSTLSRKFVEVMTEYNATQSKYRDRCKDRIQRQLEITGRTTTNEELEDMLESGKLAIFTDDIKMDSQMTKQALNEIETRHNEIIKLETSIRELHDMFVDMAMLVESQGEMIDRIEYNVEHSVDYVERAVSDTKKAVKYQSKARRKKIMIIICCVVLGVVLASSIGGTLGL

SEQ ID NO: 66243 - protein, 287 aa, Homo sapiens
MRDRLPDLTACRKNDDGDTVVVVEKDHFMDDFFHQVEEIRNSIDKITQYVEEVKKNHSIILSAPNPEGKIKEELEDLNKEIKKTANKIRAKLKAIEQSFDQDESGNRTSVDLRIRRTQHSVLSRKFVEAMAEYNEAQTLFRERSKGRIQRQLEITGRTTTDDELEEMLESGKPSIFTSDIISDSQITRQALNEIESRHKDIMKLETSIRELHEMFMDMAMFVETQGEMINNIERNVMNATDYVEHAKEETKKAIKYQSKARRKLMFIIICVIVLLVILGIILATTLS

SEQ ID NO: 66244 - protein, 288 aa, Homo sapiens
MRDRLPDLTACRKNDDGDTVVVVEKDHFMDDFFHQVEEIRNSIDKITQYVEEVKKNHSIILSAPNPEGKIKEELEDLNKEIKKTANKIRAKLKAIEQSFDQDESGNRTSVDLRIRRTQHSVLSRKFVEAMAEYNEAQTLFRERSKGRIQRQLEITGRTTTDDELEEMLESGKPSIFTSDIISDSQITRQALNEIESRHKDIMKLETSIRELHEMFMDMAMFVETQGEMINNIERNVMNATDYVEHAKEETKKAIKYQSKARRKKWIIIAVSVVLVAIIALIIGLSVGK

SEQ ID NO: 66245 - protein, 258 aa, Homo sapiens
MDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGEMLDNIELNVMHTVDHVEKARDETKKAVKYQSQARKKLIIIIVLVVVLLGILALIIGLSVGLN

SEQ ID NO: 66246 - protein, 289 aa, Homo sapiens
MKDRLEQLKAKQLTQDDDTDAVEIAIDNTAFMDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGEMLDNIELNVMHTVDHVEKARDETKKAVKYQSQARKKLIIIIVLVVVLLGILALIIGLSVGLN

SEQ ID NO: 66247 - protein, 180 aa, Homo sapiens
MEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGSMIDRIENNMDQSVGFVERAVADTKKAVKYQSEARRKLISLQTGVATLVFR

SEQ ID NO: 66248 - protein, 277 aa, Homo sapiens
MKDRLEQLKAKQLTQDDDTDAVEIAIDNTAFMDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGEMLDNIELNVMHTVDHVEKARDETKKAVKYQSQARKKLISLQTGVATLVFR

SEQ ID NO: 66249 - protein, 76 aa, Homo sapiens
MFMDIAMLVENQGEMLDNIELNVMHTVDHVEKARDETKKAVKYQSQARKKLIIIIVLVVVLLGILALIIGLSVGLN

SEQ ID NO: 66250 - protein, 252 aa, Homo sapiens
MKDRLEQLKAKQLTQDDDTDAVEIAIDNTAFMDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQKLIIIIVLVVVLLGILALIIGLSVGLN

SEQ ID NO: 66251 - protein, 297 aa, Homo sapiens
MRDRTHELRQGDDSSDEEDKERVALVVHPGTARLGSPDEEFFHKVRTIRQTIVKLGNKVQELEKQQVTILATPLPEESMKQELQNLRDEIKQLGREIRLQLKAIEPQKEEADENYNSVNTRMRKTQHGVLSQQFVELINKCNSMQSEYREKNVERIRRQLKITNAGMVSDEELEQMLDSGQSEVFVSNILKDTQVTRQALNEISARHSEIQQLERSIRELHDIFTFLATEVEMQGEMINRIEKNILSSADYVERGQEHVKTALENQKKARKKKVLIAICVSITVVLLAVIIGVTVVG

SEQ ID NO: 66252 - protein, 295 aa, Homo sapiens
MGMTARTKRTRSGSRWWCTRARHGWGARTRSSSTSPLGHPPQVRTIRQTIVKLGNKVQELEKQQVTILATPLPEESMKQELQNLRDEIKQLGREIRLQLKAIEPQKEEADENYNSVNTRMRKTQHGVLSQQFVELINKCNSMQSEYREKNVERIRRQLKITNAGMVSDEELEQMLDSGQSEVFVSNILKDTQVTRQALNEISARHSEIQQLERSIRELHDIFTFLATEVEMQGEMINRIEKNILSSADYVERGQEHVKTALENQKKARKKKVLIAICVSITVVLLAVIIGVTVVG

SEQ ID NO: 66253 - protein, 355 aa, Homo sapiens
MIPRKRYGSKNTDQGVYLGLSKTQVLSPATAGSSSSDIAPLPPPVTLVPPPPDTMSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQRIDENVLGAQLDVEAAHSEILKYFQSVTSNRWLMVKIFLILIVFFIIFVVFLA

SEQ ID NO: 66254 - protein, 321 aa, Homo sapiens
MIPRKRYGSKNTDQGVYLGLSKTQVLSPATAGSSSSDIAPLPPPVTLVPPPPDTMSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQSVLLFPLLPALSPGSTRTC

SEQ ID NO: 66255 - protein, 301 aa, Homo sapiens
MSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQRIDENVLGAQLDVEAAHSEILKYFQSVTSNRWLMVKIFLILIVFFIIFVVFLA

SEQ ID NO: 66256 - protein, 259 aa, Homo sapiens
MAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQRIDENVLGAQLDVEAAHSEILKYFQSVTSNRWLMVKIFLILIVFFIIFVVFLA

SEQ ID NO: 66257 - protein, 239 aa, Homo sapiens
MSYTPGVGGDPAQLAQRISSNIQKITQCSVEIQRTLNQLGTPQDSPELRQQLQQKQQYTNQLAKETDKYIKEFGSLPTTPSEQRQRKIQKDRLVAEFTTSLTNFQKVQRQAAEREKEFVARVRASSRVSGSFPEDSSKERNLVSWESQTQPQVQVQDEEITEDDLRLIHERESSIRQLEADIMDINEIFKDLGMMIHEQGDVIDSIEANVENAEVHVQQANQQLSRAADYQKKDSCMLM

SEQ ID NO: 66258 - protein, 261 aa, Homo sapiens
MSYTPGVGGDPAQLAQRISSNIQKITQCSVEIQRTLNQLGTPQDSPELRQQLQQKQQYTNQLAKETDKYIKEFGSLPTTPSEQRQRKIQKDRLVAEFTTSLTNFQKVQRQAAEREKEFVARVRASSRVSGSFPEDSSKERNLVSWESQTQPQVQVQDEEITEDDLRLIHERESSIRQLEADIMDINEIFKDLGMMIHEQGDVIDSIEANVENAEVHVQQANQQLSRAADYQRKSRKTLCIIILILVIGVAIISLIIWGLNH

SEQ ID NO: 66259 - protein, 261 aa, Homo sapiens; identical to SEQ ID NO: 66258

SEQ ID NO: 66260 - protein, 236 aa, Homo sapiens
MAPDPWFSTYDSTCQIAQEIAEKIQQRNQYERKGEKAPKLTVTIRALLQNLKEKIALLKDLLLRAVSTHQITQLEGDRRQNLLDDLVTRERLLLASFKNEGAEPDLIRSSLMSEEAKRGAPNPWLFEEPEETRGLGFDEIRQQQQKIIQEQDAGLDALSSIISRQKQMGQEIGNELDEQNEIIDDLANLVENTDEKLRNETRRVNMVDRKSASCGMIMVILLLLVAIVVVAVWPTN

SEQ ID NO: 66261 - protein, 594 aa, Homo sapiens
MAPIGLKAVVGEKIMHDVIKKVKKKGEWKVLVVDQLSMRMLSSCCKMTDIMTEGITIVEDINKRREPLPSLEAVYLITPSEKSVHSLISDFKDPPTAKYRAAHVFFTDSCPDALFNELVKSRAAKVIKTLTEINIAFLPYESQVYSLDSADSFQSFYSPHKAQMKNPILERLAEQIATLCATLKEYPAVRYRGEYKDNALLAQLIQDKLDAYKADDPTMGEGPDKARSQLLILDRGFDPSSPVLHELTFQAMSYDLLPIENDVYKYETSGIGEARVKEVLLDEDDDLWIALRHKHIAEVSQEVTRSLKDFSSSKRMNTGEKTTMRDLSQMLKKMPQYQKELSKYSTHLHLAEDCMKHYQGTVDKLCRVEQDLAMGTDAEGEKIKDPMRAIVPILLDANVSTYDKIRIILLYIFLKNGITEENLNKLIQHAQIPPEDSEIITNMAHLGVPIVTDSTLRRRSKPERKERISEQTYQLSRWTPIIKDIMEDTIEDKLDTKHYPYISTRSSASFSTTAVSARYGHWHKNKAPGEYRSGPRLIIFILGGVSLNEMRCAYEVTQANGKWEVLIGSTHILTPQKLLDTLKKLNKTDEEISS

SEQ ID NO: 66262 - protein, 557 aa, Homo sapiens
MTDIMTEGITIVEDINKRREPLPSLEAVYLITPSEKSVHSLISDFKDPPTAKYRAAHVFFTDSCPDALFNELVKSRAAKVIKTLTEINIAFLPYESQVYSLDSADSFQSFYSPHKAQMKNPILERLAEQIATLCATLKEYPAVRYRGEYKDNALLAQLIQDKLDAYKADDPTMGEGPDKARSQLLILDRGFDPSSPVLHELTFQAMSYDLLPIENDVYKYETSGIGEARVKEVLLDEDDDLWIALRHKHIAEVSQEVTRSLKDFSSSKRMNTGEKTTMRDLSQMLKKMPQYQKELSKYSTHLHLAEDCMKHYQGTVDKLCRVEQDLAMGTDAEGEKIKDPMRAIVPILLDANVSTYDKIRIILLYIFLKNGITEENLNKLIQHAQIPPEDSEIITNMAHLGVPIVTDSTLRRRSKPERKERISEQTYQLSRWTPIIKDIMEDTIEDKLDTKHYPYISTRSSASFSTTAVSARYGHWHKNKAPGEYRSGPRLIIFILGGVSLNEMRCAYEVTQANGKWEVLIGSTHILTPTKFLMDLRHPDFRESSRVSFEDQAPTME

SEQ ID NO: 66263 - protein, 435 aa, Homo sapiens
MAPIGLKAVVGEKIMHDVIKKVKKKGEWKVLVVDQLSMRMLSSCCKMTDIMTEGPDKARSQLLILDRGFDPSSPVLHELTFQAMSYDLLPIENDVYKYETSGIGEARVKEVLLDEDDDLWIALRHKHIAEVSQEVTRSLKDFSSSKRMNTGEKTTMRDLSQMLKKMPQYQKELSKYSTHLHLAEDCMKHYQGTVDKLCRVEQDLAMGTDAEGEKIKDPMRAIVPILLDANVSTYDKIRIILLYIFLKNGITEENLNKLIQHAQIPPEDSEIITNMAHLGVPIVTDSTLRRRSKPERKERISEQTYQLSRWTPIIKDIMEDTIEDKLDTKHYPYISTRSSASFSTTAVSARYGHWHKNKAPGEYRSGPRLIIFILGGVSLNEMRCAYEVTQANGKWEVLIGSTHILTPTKFLMDLRHPDFRESSRVSFEDQAPTME

SEQ ID NO: 66264 - protein, 603 aa, Homo sapiens [sequence omitted]

SEQ ID NO: 66265 - protein, 593 aa, Homo sapiens
MAPSGLKAVVGEKILSGVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGIEARAGPRLIVYVMGGVAMSEMRAAYEVTRATEGKWEVLIGSSHILTPTRFLDDLKALDKKLEDIALP

SEQ ID NO: 66266 - protein, 398 aa, Homo sapiens
MCIRVHVSMCMCMCVHVCVHLCMHVCAVCMCVYVCVCVHVHVCASVCAFVCMCVCVCVCGSVCAFVSVHVCMRVYVCVCICVHLYVCVCVCLCACVYACVCMCLRLCVRLCVSVCACVYACICMCICVHVSMYVCASVCACVCVCVCVCVCMRVCAHQCLHVCICVYVCARICVCACVYVCVCISVCACVYVCVHLCVCACVHACVCVCACVHLCVCACAHVGATLVCICTYTCPRPSMFAHGGRWGVAGRPRQPMSLGVQAQAQRVIHLPQSVQALIKDFQGTPTFTYKAAHIFFTDTCPEPLFSELGRSRLAKVVKTLKEIHLAFLPYEAQVRPGLILGRGWGFVTKCPLFPQKQTLRLGAVAHTCNPSAVGGQGRRITWGQEFETSLGTEQDPVS

SEQ ID NO: 66267 - protein, 590 aa, Homo sapiens
MAPSGLKAVVGEKILSGVIRSVKKDGEWKVLIMDHPSMRILSSCCKMSDILAEGITIVEDINKRREPIPSLEAIYLLSPTEKALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGIEARAGPRLIVYVMGGVAMSEMRAAYEVTRATEGKWEVLIGSSHILTPTRFLDDLKALDKKLEDIALP

SEQ ID NO: 66268 - protein, 604 aa, Homo sapiens
MAPSGLKAVVGEKILSGVIRSVKKDGEWKVLIMDHPSMRILSSCCKMSDILAEGITIVEDINKRREPIPSLEAIYLLSPTEKAQAQRVIHLPQSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGIEARAGPRLIVYVMGGVAMSEMRAAYEVTRATEGKWEVLIGSSHILTPTRFLDDLKALDKKLEDIALP

SEQ ID NO: 66269 - protein, 579 aa, Homo sapiens
MAPSGLKAVVGEKILSGVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGIEARAGPRLIVYVMGGVAMSEMRAAYEVTRATEGSGRCSLAPHTSSPRPASWMT

SEQ ID NO: 66270 - protein, 806 aa, Homo sapiens
MHGKSTAVLEMDYSIVDFLTLCETPYPNDFQEPYAVVVLLEKDLVLIDLAQNGYPIFENPYPLSIHESPVTCCEYFADCPVDLIPALYSVGARQKRQGYSKKEWPINGGNWGLGAQSYPEIIITGHADGSVKFWDASAITLQVLYKLKTSKVFEKSRNKDDRPNTDIVDEDPYAIQIISWCPESRMLCIAGVSAHVIIYRFSKQEVITEVIPMLEVRLLYEINDVETPEGEQPPPLPTPVGGSNPQPIPPQSHPSTSSSSSDGLRDNVPCLKVKNSPLKQSPGYQTELVIQLVWVGGEPPQQITSLAVNSSYGLVVFGNCNGIAMVDYLQKAVLLNLGTIELYGSNDPYRREPRSPRKSRQPSGAGLCDISEGTVVPEDRCKSPTSGSSSPHNSDDEQKMNNFIEKAKMSRKLSLPTDLKPDLDVKDNSFSRSRSSSVTSIDKESREAISALHFCETFTRKTDSSPSPCLWVGTTLGTVLVIALNLPPGGEQRLLQPVIVSPSGTILRLKGAILRMAFLDTTGCLIPPAYEPWREHNVPEEKDEKEKLKKRRPVSVSPSSSQEISENQYAVICSEKQAKVISLPTQNCAYKQNITETSFVLRGDIVALSNSICLACFCANGHIMTFSLPSLRPLLDVYYLPLTNMRIARTFCFTNNGQALYLVSPTEIQRLTYSQETCENLQEMLGELFTPVETPEAPNRGFFKGLFGGGAQSLDREELFGESSSGKASRSLAQHIPGPGGIEGVKGAASGVVGELARARLALDERGQKLGDLEERTAAMLSSAESFSKHAHEIMLKYKDKKWYQF

SEQ ID NO: 66271 - protein, 1151 aa, Homo sapiens
MRKFNIRKVLDGLTAGSSSASQQQQQQHPPGNREPEIQETLQSEHFQLCKTVRHGFPYQPSALAFDPVQKILAVGTQTGALRLFGRPGVECYCQHDSGAAVIQLQFLINEGALVSALADDTLHLWNLRQKRPAILHSLKFCRERVTFCHLPFQSKWLYVGTERGNIHIVNVESFTLSGYVIMWNKAIELSSKSHPGPVVHISDNPMDEGKLLIGFESGTVVLWDLKSKKADYRYTYDEAIHSVAWHHEGKQFICSHSDGTLTIWNVRSPAKPVQTITPHGKQLKDGKKPEPCKPILKVEFKTTRSGEPFIILSGGLSYDTVGRRPCLTVMHGKSTAVLEMDYSIVDFLTLCETPYPNDFQEPYAVVVLLEKDLVLIDLAQNGYPIFENPYPLSIHESPVTCCEYFADCPVDLIPALYSVGARQKRQGYSKKEWPINGGNWGLGAQSYPEIIITGHADGSVKFWDASAITLQVLYKLKTSKVFEKSRNKDDRPNTDIVDEDPYAIQIISWCPESRMLCIAGVSAHVIIYRFSKQEVITEVIPMLEVRLLYEINDVETPEGEQPPPLPTPVGGSNPQPIPPQSHPSTSSSSSDGLRDNVPCLKVKNSPLKQSPGYQTELVIQLVWVGGEPPQQITSLAVNSSYGLVVFGNCNGIAMVDYLQKAVLLNLGTIELYGSNDPYRREPRSPRKSRQPSGAGLCDISEGTVVPEDRCKSPTSGSSSPHNSDDEQKMNNFIEKVKTKSRKFSKMVANDIAKMSRKLSLPTDLKPDLDVKDNSFSRSRSSSVTSIDKESREAISALHFCETFTRKTDSSPSPCLWVGTTLGTVLVIALNLPPGGEQRLLQPVIVSPSGTILRLKGAILRMAFLDTTGCLIPPAYEPWREHNVPEEKDEKEKLKKRRPVSVSPSSSQEISENQYAVICSEKQAKVISLPTQNCAYKQNITETSFVLRGDIVALSNSICLACFCANGHIMTFSLPSLRPLLDVYYLPLTNMRIARTFCFTNNGQALYLVSPTEIQRLTYSQETCENLQEMLGELFTPVETPEAPNRGFFKGLFGGGAQSLDREELFGESSSGKASRSLAQHIPGPGGIEGVKGAASGVVGELARARLALDERGQKLGDLEERTAAMLSSAESFSKHAHEIMLKYKDKKWYQF

SEQ ID NO: 66272 - protein, 174 aa, Homo sapiens
  MOD_RES (1)..(1): Any amino acid
XKAVLLNLGTIELYGSNDPYRREPRSPRKSRQPSGAGLCDISEGTVVPEDRCKSPTSGSSSPHNSDDEQKMNNFIEKAKMSRKLSLPTDLKPDLDVKDNSFSRSRSSSVTSIDKESREAISALHFCETFTRKTDSSPSPCLWVGTTLGTVLVIALNLPPGGEQRLLQPVIVSPS

SEQ ID NO: 66273 - protein, 279 aa, Homo sapiens
MVDYLQKAVLLNLGTIELYGSNDPYRREPRSPRKSRQPSGGVLIVTSCMCGLSSLYSESMKKLRSSFLTGLCDISEGTVVPEDRCKSPTSAKMSRKLSLPTDLKPDLDVKDNSFSRSRSSSVTSIDKESREAISALHFCETFTRKTDSSPSPCLWVGTTLGTVLVIALNLPPGGEQRLLQPVIVSPSGTILRLKGAILRMAFLDTTGCLIPPAYEPWREHNVPEEKDEKEKLKKRRPVSVSPSSSQEISENQYAVICSEKQAKVISLPTQNCAYKQNIT

SEQ ID NO: 66274 - protein, 1098 aa, Homo sapiens
MRKFNIRKVLDGLTAGSSSASQQQQQQHPPGNREPEIQETLQSEHFQLCKTVRHGFPYQPSALAFDPVQKILAVGTQTGALRLFGRPGVECYCQHDSGAAVIQLQFLINEGALVSALADDTLHLWNLRQKRPAILHSLKFCRERVTFCHLPFQSKWLYVGTERGNIHIVNVESFTLSGYVIMWNKAIELSSKSHPGPVVHISDNPMDEGKLLIGFESGTVVLWDLKSKKADYRYTYDEAIHSVAWHHEGKQFICSHSDGTLTIWNVRSPAKPVQTITPHGKQLKDGKKPEPCKPILKVEFKTTRSGEPFIILSGGLSYDTVGRRPCLTVMHGKSTAVLEMDYSIVDFLTLCETPYPNDFQEPYAVVVLLEKDLVLIDLAQNGYPIFENPYPLSIHESPVTCCEYFADCPVDLIPALYSVGARQKRQGYSKKEWPINGGNWGLGAQSYPEIIITGHADGSVKFWDASAITLQVLYKLKTSKVFEKSRNKDDRPNTDIVDEDPYAIQIISWCPESRMLCIAGVSAHVIIYRFSKQEVITEVIPMLEVRLLYEINDVETPEGEQPPPLPTPVGGSNPQPIPPQSHPSTSSSSSDGLRDNVPCLKVKNSPLKQSPGYQTELVIQLVWVGGEPPQQITSLAVNSSYGLVVFGNCNGIAMVDYLQKAVLLNLGTIELYGSNDPYRREPRSPRKSRQPSGAGLCDISEGTVVPEDRCKSPTSDVKDNSFSRSRSSSVTSIDKESREAISALHFCETFTRKTDSSPSPCLWVGTTLGTVLVIALNLPPGGEQRLLQPVIVSPSGTILRLKGAILRMAFLDTTGCLIPPAYEPWREHNVPEEKDEKEKLKKRRPVSVSPSSSQEISENQYAVICSEKQAKVISLPTQNCAYKQNITETSFVLRGDIVALSNSICLACFCANGHIMTFSLPSLRPLLDVYYLPLTNMRIARTFCFTNNGQALYLVSPTEIQRLTYSQETCENLQEMLGELFTPVETPEAPNRGFFKGLFGGGAQSLDREELFGESSSGKASRSLAQHIPGPGGIEGVKGAASGVVGELARARLALDERGQKLGDLEERTAAMLSSAESFSKHAHEIMLKYKDKKWYQF

SEQ ID NO: 66275 - protein, 1115 aa, Homo sapiens
MRKFNIRKVLDGLTAGSSSASQQQQQQHPPGNREPEIQETLQSEHFQLCKTVRHGFPYQPSALAFDPVQKILAVGTQTGALRLFGRPGVECYCQHDSGAAVIQLQFLINEGALVSALADDTLHLWNLRQKRPAILHSLKFCRERVTFCHLPFQSKWLYVGTERGNIHIVNVESFTLSGYVIMWNKAIELSSKSHPGPVVHISDNPMDEGKLLIGFESGTVVLWDLKSKKADYRYTYDEAIHSVAWHHEGKQFICSHSDGTLTIWNVRSPAKPVQTITPHGKQLKDGKKPEPCKPILKVEFKTTRSGEPFIILSGGLSYDTVGRRPCLTVMHGKSTAVLEMDYSIVDFLTLCETPYPNDFQEPYAVVVLLEKDLVLIDLAQNGYPIFENPYPLSIHESPVTCCEYFADCPVDLIPALYSVGARQKRQGYSKKEWPINGGNWGLGAQSYPEIIITGHADGSVKFWDASAITLQVLYKLKTSKVFEKSRNKDDRPNTDIVDEDPYAIQIISWCPESRMLCIAGVSAHVIIYRFSKQEVITEVIPMLEVRLLYEINDVETPEGEQPPPLPTPVGGSNPQPIPPQSHPSTSSSSSDGLRDNVPCLKVKNSPLKQSPGYQTELVIQLVWVGGEPPQQITSLAVNSSYGLVVFGNCNGIAMVDYLQKAVLLNLGTIELYGSNDPYRREPRSPRKSRQPSGAGLCDISEGTVVPEDRCKSPTSAKMSRKLSLPTDLKPDLDVKDNSFSRSRSSSVTSIDKESREAISALHFCETFTRKTDSSPSPCLWVGTTLGTVLVIALNLPPGGEQRLLQPVIVSPSGTILRLKGAILRMAFLDTTGCLIPPAYEPWREHNVPEEKDEKEKLKKRRPVSVSPSSSQEISENQYAVICSEKQAKVISLPTQNCAYKQNITETSFVLRGDIVALSNSICLACFCANGHIMTFSLPSLRPLLDVYYLPLTNMRIARTFCFTNNGQALYLVSPTEIQRLTYSQETCENLQEMLGELFTPVETPEAPNRGFFKGLFGGGAQSLDREELFGESSSGKASRSLAQHIPGPGGIEGVKGAASGVVGELARARLALDERGQKLGDLEERTAAMLSSAESFSKHAHEIMLKYKDKKWYQF

SEQ ID NO: 66276 - protein, 264 aa, Homo sapiens
IELYGSNDPYRREPRSPRKSRQPSGGVLIVTSCMCGLSSLYSESMKKLRSSFLTGLCDISEGTVVPEDRCKSPTSAKMSRKLSLPTDLKPDLDVKDNSFSRSRSSSVTSIDKESREAISALHFCETFTRKTDSSPSPCLWVGTTLGTVLVIALNLPPGGEQRLLQPVIVSPSGTILRLKGAILRMAFLDTTGCLIPPAYEPWREHNVPEEKDEKEKLKKRRPVSVSPSSSQEISENQYAVICSEKQAKVISLPTQNCAYKQNIT

SEQ ID NO: 66277 - protein, 308 aa, Homo sapiens
MRKFNIRKVLDGLTAGSSSASQQQQQQHPPGNREPEIQETLQSEHFQLCKTVRHGFPYQPSALAFDPVQKILAVGTQTGALRLFGRPGVECYCQHDSGAAVIQLQFLINEGALVSALADDTLHLWNLRQKRPAILHSLKFCRERVTFCHLPFQSKWLYVGTERGNIHIVNVESFTLSGYVIMWNKAIELSSKSHPGPVVHISDNPMDEGKLLIGFESGTVVLWDLKSKKADYRYTYDEAIHSVAWHHEGKQFICSHSDGTLTIWNVRSPAKPVQTITPHGKQLKDGKKPEPCKPILKVEFKTTRSGVC

SEQ ID NO: 66278 - protein, 1186 aa, Homo sapiens
MKKFNFRKVLDGLTASSPGSGSSSGSNSGGGAGSGSVHPAGTAGVLREEIQETLTSEYFQICKTVRHGFPHQPTALAFDPVQKILAIGTRTGAIRILGRPGVDCYCQHESGAAVLQLQFLINEGALVSASSDDTLHLWNLRQKRPAILHSLKFNRERITYCHLPFQSKWLYVGTERGNTHIVNIESFILSGYVIMWNKAIELSTKTHPGPVVHLSDSPRDEGKLLIGYENGTVVFWDLKSKRAELRVYYDEAIHSIDWHHEGKQFMCSHSDGSLTLWNLKSPSRPFQTTIPHGKSQREGRKSESCKPILKVEYKTCKNSEPFIIFSGGLSYDKACRRPSLTIMHGKAITVLEMDHPIVEFLTLCETPYPNEFQEPYAVVVLLEKDLIVVDLTQSNFPIFENPYPMDIHESPVTCTAYFADCPPDLILVLYSIGVKHKKQGYSNKEWPISGGAWNLGAQTYPEIIITGHADGSIKFWDASAITLQMLYKLKTSKVFEKQKVGEGKQTCEIVEEDPFAIQMIYWCPESRIFCVSGVSAYVIIYKFSRHEITTEIVSLEVRLQYDVEDIITPEPETSPPFPDLSAQLPSSRSLSGSTNTVASEGVTKDSIPCLNVKTRPVRMPPGYQAELVIQLVWVDGEPPQQITSLAVSSAYGIVAFGNCNGLAVVDFIQKTVLLSMGTIDLYRSSDLYQRQPRSPRKNKQFIADNFCMRGLSNFYPDLTKRIRTSYQSLTELNDSPVPLELERCKSPTSDHVNGHCTSPTSQSCSSGKRLSSADVSKVNRWGPGRPPFRKAQSAACMEISLPVTTEENRENSYNRSRSSSISSIDKDSKEAITALYFMDSFARKNDSTISPCLFVGTSLGMVLIISLNLPLADEQRFTEPVMVLPSGTFLSLKGAVLTFSCMDRMGGLMQPPYEVWRDPNNIDENEKSWRRKVVMNSSSASQEIGDHQYTIICSEKQAKVFSLPSQTCLYVHNITETSFILQANVVVMCSSACLACFCANGHIMIMSLPSLRPMLDVNYLPLTDMRIARTFCFTNEGQALYLVSPTEIQRLTYSQEMCDNLQDMLGDLFTPIETPEAQNRGFLKGLFGGSGQTFDREELFGEASAGKASRSLAQHIPGPGSIEGMKGAAGGVMGELTRARIALDERGQRLGELEEKTAGMMTSAEAFSKHAHELMLKYKDKKWYQF

SEQ ID NO: 66279 - protein, 127 aa, Homo sapiens
MKKFNFRKVLDGLTASSPGSGSSSGSNSGGGAGSGSVHPAGTAGVLREEIQETLTSEYFQICKTVRHGFPHQPTALAFDPVQKILAIGTRTGAIRILGRPGVDCYCQHESGAAVLQLQFLINEGALV

SEQ ID NO: 66280 - protein, 210 aa, Homo sapiens
MSAKSAISKEIFAPLDERMLGAVQVKRRTKKKIPFLATGGQGEYLTYICLSVTNKKPTQASITKVKQFEGSTSFVRRSQWMLEQLRQVNGIDPNGDSAEFDLLFENAFDQWVASTASEKCTFFQILHHTCQRYLTDRKPEFINCQSKIMGGNSILHSAADSVTSAVQKASQALNERGERLGRAEEKTEDLKNSAQQFAETAHKLAMKHKC

SEQ ID NO: 66281 - protein, 210 aa, Homo sapiens
MSAKSAISKEIFAPLDERMLGAVQVKRRTKKKIPFLATGGQGEYLTYICLSVTNKKPTQASITKVKQFEGSTSFVRRSQWMLEQLRQVNGIDPNGDSAEFDLLFENAFDQWVASTASEKCTFFQILHHTCQRYLTDRKPEFINCQSKIMGGNSILHSAADSVTSAVQKASQALNERGERLGRAEEKTEDLKNSAQQFAETAHKVTFRGRK

SEQ ID NO: 66282 - protein, 210 aa, Homo sapiens; identical to SEQ ID NO: 66280

SEQ ID NO: 66283 - protein, 210 aa, Homo sapiens; identical to SEQ ID NO: 66280

SEQ ID NO: 66284 - protein, 210 aa, Homo sapiens; identical to SEQ ID NO: 66280

SEQ ID NO: 66285 - protein, 108 aa, Homo sapiens
MSACFLDTRRAAFLQCDLPSSYRILTLPESGHCGSAEPVSDAPALLLSGNSILHSAADSVTSAVQKASQALNERGERLGRAEEKTEDLKNSAQQFAETAHKLAMKHKC

SEQ ID NO: 66286 - protein, 210 aa, Homo sapiens; identical to SEQ ID NO: 66280

SEQ ID NO: 66287 - protein, 210 aa, Homo sapiens; identical to SEQ ID NO: 66280

SEQ ID NO: 66288 - protein, 538 aa, Homo sapiens [sequence omitted]

SEQ ID NO: 66289 - protein, 538 aa, Homo sapiens [sequence omitted]

SEQ ID NO: 66290 - protein, 28 aa, Homo sapiens
MAVAAAAAAAGPAGAGGGRAQRSGLLEV

SEQ ID NO: 66291 - protein, 540 aa, Homo sapiens
MRVAAATAAAGAGPAMAVWTRATKAGLVELLLRERWVRVVAELSGESLSLTGDAAAAELEPALGPAAAAFNGLPNGGGAGDSLPGSPSRGLGPPSPPAPPRGPAGEAGASPPVRRVRVVKQEAGGLGISIKGGRENRMPILISKIFPGLAADQSRALRLGDAILSVNGTDLRQATHDQAVQALKRAGKEVLLEVKFIREVTPYIKKPSLVSDLPWEGAAPQSPSFSGSEDSGSPKHQNSTKDRKIIPLKMCFAARNLSMPDLENRLIELHSPDSRNTLILRCKDTATAHSWFVAIHTNIMALLPQVLAELNAMLGATSTAGGSKEVKHIAWLAEQAKLDGGRQQWRPVLMAVTEKDLLLYDCMPWTRDAWASPCHSYPLVATRLVHSGSGCRSPSLGSDLTFATRTGSRQGIEMHLFRVETHRDLSSWTRILVQGCHAAAELIKEVSLGCMLNGQEVRLTIHYENGFTISRENGGSSSILYRYPFERLKMSADDGIRNLYLDFGGPEGELTMDLHSCPKPIVFVLHTFLSAKVTRMGLLV

SEQ ID NO: 66292 - protein, 480 aa, Homo sapiens
MDFRTACEETKTGICLLQDGNQEPFKVRLHLAKDILMIQEQDVICVSGEPFYSGERTVTIRRQTVGGFGLSIKGGAEHNIPVVVSKISKEQRAELSGLLFIGDAILQINGINVRKCRHEEVVQVLRNAGEEVTLTVSFLKRAPAFLKLPLNEDCACAPSDQSSGTSSPLCDSGLHLNYHPNNTDTLSCSSWPTSPGLRWEKRWCDLRLIPLLHSRFSQYVPGTDLSRQNAFQVIAVDGVCTGIIQCLSAEDCVDWLQAIATNISNLTKHNIKKINRNFPVNQQIVYMGWCEAREQDPLQDRVYSPTFLALRGSCLYKFLAPPVTTWDWTRAEKTFSVYEIMCKILKDSDLLDRRKQCFTVQSESGEDLYFSVELESDLAQWERAFQTATFLEVERIQCKTYACVLESHLMGLTIDFSTGFICFDAATKELEFSNLFAVLHCIHSFFAAKVACLDPLFLGNQATASTAASSATTSKAKYTT

SEQ ID NO: 66293 - protein, 480 aa, Homo sapiens; identical to SEQ ID NO: 66292

SEQ ID NO: 66294 - protein, 517 aa, Homo sapiens
MDFRTACEETKTGICLLQDGNQEPFKVRLHLAKDILMIQEQDVICVSGEPFYSGERTVTIRRQTVGGFGLSIKGGAEHNIPVVVSKISKEQRAELSGLLFIGDAILQINGINVRKCRHEEVVQVLRNAGEEVTLTVSFLKRAPAFLKLPLNEDCACAPSDQSSGTSSPLCDSGLHLNYHPNNTDTLSCSSWPTSPGLRWEKRWCDLRLIPLLHSRFSQYVPGTDLSRQNAFQVIAVDGVCTGIIQCLSAEDCVDWLQAIATNISNLTKHNIKKINRNFPVNQQIVYMGWCEAREQDPLQDRVYSPTFLALRGSCLYKFLAPPVTTWDWTRAEKTFSVYEIMCKILKDSDLLDRRKQCFTVQSESGEDLYFSVELESDLAQWERAFQTATFLEVERIQCKTYACVLESHLMGLTIDFSTGFICFDAATKAVLWRYKFSQLKGSSDDGKSKIKFLFQNPDTKQIEAKELEFSNLFAVLHCIHSFFAAKVACLDPLFLGNQATASTAASSATTSKAKYTT

SEQ ID NO: 66295 - protein, 517 aa, Homo sapiens; identical to SEQ ID NO: 66294

SEQ ID NO: 66296 - protein, 92 aa, Homo sapiens
MDFRTACEETKTGICLLQDGNQEPFKVRLHLAKDILMIQEQDVICVSGEPFYSGERTVTIRRQTVGGFGLSIKGGAEHNIPVVVSKISKEQR

SEQ ID NO: 66297 - protein, 140 aa, Homo sapiens
MDVFMKGLSKAKEGVVAAAEKTKQGVAEAAGKTKEGVLYVGSKTKEGVVHGVATVAEKTKEQVTNVGGAVVTGVTAVAQKTVEGAGSIAAATGFVKKDQLGKNEEGAPQEGILEDMPVDPDNEAYEMPSEEGYQDYEPEA

SEQ ID NO: 66298 - protein, 112 aa, Homo sapiens
MDVFMKGLSKAKEGVVAAAEKTKQGVAEAAGKTKEGVLYVGSKTKEGVVHGVATVAEKTKEQVTNVGGAVVTGVTAVAQKTVEGAGSIAAATGFVKKDQLGKEGYQDYEPEA

SEQ ID NO: 66299 - protein, 140 aa, Homo sapiens; identical to SEQ ID NO: 66297

SEQ ID NO: 66300 - protein, 126 aa, Homo sapiens
MDVFMKGLSKAKEGVVAAAEKTKQGVAEAAGKTKEGVLYVVAEKTKEQVTNVGGAVVTGVTAVAQKTVEGAGSIAAATGFVKKDQLGKNEEGAPQEGILEDMPVDPDNEAYEMPSEEGYQDYEPEA

SEQ ID NO: 66301 - protein, 140 aa, Homo sapiens; identical to SEQ ID NO: 66297

SEQ ID NO: 66302 - protein, 112 aa, Homo sapiens; identical to SEQ ID NO: 66298

SEQ ID NO: 66303 - protein, 115 aa, Homo sapiens
MDVFMKGLSKAKEGVVAAAEKTKQGVAEAAGKTKEGVLYVGSKTKEGVVHGVATVAEKTKEQVTNVGGAVVTGVTAVAQKTVEGAGSIAAATGFVKKDQLGKVWLCTFCVTFISW

SEQ ID NO: 66304 - protein, 126 aa, Homo sapiens; identical to SEQ ID NO: 66300

SEQ ID NO: 66305 - protein, 140 aa, Homo sapiens; identical to SEQ ID NO: 66297

SEQ ID NO: 66306 - protein, 67 aa, Homo sapiens
MDVFMKGLSKAKEGVVAAAEKTKQGVAEAAGKTKEGVLYVGSKTKEGVVHGVATVAEKTKEQVTNVG

SEQ ID NO: 66307 - protein, 140 aa, Homo sapiens; identical to SEQ ID NO: 66297

SEQ ID NO: 66308 - protein, 919 aa, Homo sapiens
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLPHLAADNLDKIHDENGNNLLHIAASQGHAECLQHLTSLMGEDCLNERNTEKLTPAGLAIKNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAA

SEQ ID NO: 66309 - protein, 1016 aa, Homo sapiens
MEAPEYLDLDEIDFSDDISDNRSQGNRLQKLGLEDTDREDAMGFGSHRAKLTVVAALGACHCPENEYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLPHLAADNLDKIHDENGNNLLHIAASQGHAECLQHLTSLMGEDCLNERNTEKLTPAGLAIKNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAEMYSSCINLSSNMLIEEHLCNDTRHNDINRKMKKSYSIKHIAEPESKELFL

SEQ ID NO: 66310 - protein, 859 aa, Homo sapiens
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAA

SEQ ID NO: 66311 - protein, 603 aa, Homo sapiens
MTYLIQSHHSRRSQNCAEDVIRKTKTDQNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAEMYSSCINLSSNMLIEEHLCNDTRHNDINRKMKKSYSIKHIAEPESKELFL

SEQ ID NO: 66312 - protein, 521 aa, Homo sapiens
MKLTLVMTYLIQSHHSRRSQNCAEDVIRKTKTDQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAA

SEQ ID NO: 66313 - protein, 381 aa, Homo sapiens
MKLTLVMTYLIQSHHSRRSQNCAEDVIRKTKTDQNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAGFLSASRPPNPWMATAHLPPQRAANQT

SEQ ID NO: 66314 - protein, 588 aa, Homo sapiens
MEAPEYLDLDEIDFSDDISDNRSQGNRLQKLGLEDTDREDAMGFGSHRAKLTVVAALGACHCPENEYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLPHLAADNLDKIHDENGNNLLHIAASQGHAECLQHLTSLMGEDCLNERNTEKLTPAGLAIKNGQLECVRWMVSETEAIAELSCSKDFPSLIHYAGCYGQEKILLWLLQFMQEQGISLDEVDQDGNSAVHVASQHGYLGCIQTRLKIQGTWNGSETCLFTHHFSSYPPISSGLQCQGQEGVLFIPDQVGAATNKQVLFQNQLPETKSSY

SEQ ID NO: 66315 - protein, 88 aa, Homo sapiens
MEAPEYLDLDEIDFSDDISYSVTSLKTIPELCRRCDTQNEDRSATPSCRQSRQNSRRKWKQSITYCGVTGTRRVSTAPHFFDGRRLPQ

SEQ ID NO: 66316 - protein, 98 aa, Homo sapiens
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQK

SEQ ID NO: 66317 - protein, 14 aa, Homo sapiens
MEAPEYLDLDEIDF

SEQ ID NO: 66318 - protein, 135 aa, Homo sapiens
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSE

SEQ ID NO: 66319 - protein, 477 aa, Homo sapiens
MQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAA

SEQ ID NO: 66320 - protein, 134 aa, Homo sapiens
MDVFMKGLSMAKEGVVAAAEKTKQGVTEAAEKTKEGVLYVGSKTREGVVQGVASVAEKTKEQASHLGGAVFSGAGNIAAATGLVKREEFPTDLKPEEVAQEAAEEPLIEPLMEPEGESYEDPPQEEYQEYEPEA

SEQ ID NO: 66321 - protein, 134 aa, Homo sapiens; identical to SEQ ID NO: 66320

SEQ ID NO: 66322 - protein, 134 aa, Homo sapiens; identical to SEQ ID NO: 66320

SEQ ID NO: 66323 - protein, 134 aa, Homo sapiens; identical to SEQ ID NO: 66320

SEQ ID NO: 66324 - protein, 126 aa, Homo sapiens
MDVFKKGFSIAKEGVVGAVEKTKQGVTEAAEKTKEGVMYVGAKTKENVVQSVTSGLPWGWGWGGGQPVSSHSGREDQGAGQRRERGCGEQRQHCGHQDRGGGGEHRGHLRGGAQGGLEAICPPTGG

SEQ ID NO: 66325 - protein, 127 aa, Homo sapiens
MDVFKKGFSIAKEGVVGAVEKTKQGVTEAAEKTKEGVMYVGAKTKENVVQSVTSVAEKTKEQANAVSEAVVSSVNTVATKTVEEAENIAVTSGVVRKEDLRPSAPQQEGEASKEKEEVAEEAQSGGD

SEQ ID NO: 66326 - protein, 156 aa, Homo sapiens
MAGQFRSYVWDPLLILSQIVLMQTVYYGSLGLWLALVDGLVRSSPSLDQMFDAEILGFSTPPGRLSMMSFILNALTCALGLLYFIRRGKQCLDFTVTVHFFHLLGCWFYSSRFPSALTWWLVQAVCIALMAVIGEYLCMRTELKEIPLNSAPKSNV

SEQ ID NO: 66327 - protein, 156 aa, Homo sapiens; identical to SEQ ID NO: 66326

SEQ ID NO: 66328 - protein, 118 aa, Homo sapiens
MAGQFRSYVWDPLLILSQIVLMQTVYYGSLGLWLALVDGLVRSSPSLDQMFDAEILGFSTPPGRLSMMSFILNALTCALGLLYFIRRGKQCLDFTVTVHFFHLLGCWFYSSRFPSALT

SEQ ID NO: 66329 - protein, 76 aa, Homo sapiens
MAGQFRSYVWDPLLILSQIVLMQTVYYGSLGLWLALVDGLVRSSPSLDQMFDAEILGFSTPPGRLSMMSFILNALT

SEQ ID NO: 66330 - protein, 377 aa, Homo sapiens
MSSPGTESAGKSLQYRVDHLLSAVENELQAGSEKGDPTERELRVGLEESELWLRFKELTNEMIVTKNGRRMFPVLKVNVSGLDPNAMYSFLLDFVAADNHRWKYVNGEWVPGGKPEPQAPSCVYIHPDSPNFGAHWMKAPVSFSKVKLTNKLNGGGQIMLNSLHKYEPRIHIVRVGGPQRMITSHCFPETQFIAVTAYQNEEITALKIKYNPFAKAFLDAKERSDHKEMMEEPGDSQQPGYSQSYSDNSPACLSMLQSHDNWSSLGMPAHPSMLPVSHNASPPTSSSQYPSLWSVSNGAVTPGSQAAAVSNGLGAQFFRGSPAHYTPLTHPVSAPSSSGSPLYEGAAAATDIVDSQYDAAAQGRLIASWTPVSPPSM

SEQ ID NO: 66331 - protein, 244 aa, Homo sapiens
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 66332 - protein, 311 aa, Homo sapiens
MAFLVAHPMQFVYLLTTLCVFNMVFAKLGFSETVFSQRLSFTVLSAVGYFQWQKRPHLLPVGPLGRSMRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 66333 - protein, 244 aa, Homo sapiens; identical to SEQ ID NO: 66331

SEQ ID NO: 66334 - protein, 186 aa, Homo sapiens
MSGISGCPFFLWGLLALLGLALVISLIFNISHYVEKQRQDKMYSYSSDHTRVDEYYIEDTPIYGNLDDMISEPMDENCYEQMKARPEKSVNKMQEATPSAQATNETQMCYASLDHSVKGKRRKPRKQNTHFSDKDGDEQLHAIDASVSKTTLVDSFSPESQAVEENIHDDPIRLFGLIRAKREPIN

SEQ ID NO: 66335 - protein, 435 aa, Homo sapiens
MSSPGTESAGKSLQYRVDHLLSAVENELQAGSEKGDPTERELRVGLEESELWLRFKELTNEMIVTKNGRRMFPVLKVNVSGLDPNAMYSFLLDFVAADNHRWKYVNGEWVPGGKPEPQAPSCVYIHPDSPNFGAHWMKAPVSFSKVKLTNKLNGGGQIMLNSLHKYEPRIHIVRVGGPQRMITSHCFPETQFIAVTAYQNEEITALKIKYNPFAKAFLDAKERSDHKEMMEEPGDSQQPGYSQWGWLLPGTSTLCPPANPHPQFGGALSLPSTHSCDRYPTLRSHRSSPYPSPYAHRNNSPTYSDNSPACLSMLQSHDNWSSLGMPAHPSMLPVSHNASPPTSSSQYPSLWSVSNGAVTPGSQAAAVSNGLGAQFFRGSPAHYTPLTHPVSAPSSSGSPLYEGAAAATDIVDSQYDAAAQGRLIASWTPVSPPSM

SEQ ID NO: 66336 - protein, 243 aa, Homo sapiens
MSSPGTESAGKSLQYRVDHLLSAVENELQAGSEKGDPTERELRVGLEESELWLRFKELTNEMIVTKNGRRMFPVLKVNVSGLDPNAMYSFLLDFVAADNHRWKYVNGEWVPGGKPEPQAPSCVYIHPDSPNFGAHWMKAPVSFSKVKLTNKLNGGGQIMLNSLHKYEPRIHIVRVGGPQRMITSHCFPETQFIAVTAYQNEEITALKIKYNPFAKAFLDAKERSDHKEMMEEPGDSQQPGYSQ

SEQ ID NO: 66337 - protein, 121 aa, Homo sapiens
MRIMLLFTAILAFSLAQSFGAVCKEPQEEVVPGGGRSKRDPDLYQLLQRLFKSHSSLEGLLKALSQASTDPKESTSPEKRDMHDFFVGLMGKRSVQPDSPTDVNQENVPSFGILKYPPRAE

SEQ ID NO: 66338 - protein, 121 aa, Homo sapiens; identical to SEQ ID NO: 66337

SEQ ID NO: 66339 - protein, 103 aa, Homo sapiens
MRIMLLFTAILAFSLAQSFGAVCKEPQEEVVPGGGRSKRDPDLYQLLQRLFKSHSSLEGLLKALSQASTDPKESTSPEKHSPTDVNQENVPSFGILKYPPRAE

SEQ ID NO: 66340 - protein, 121 aa, Homo sapiens; identical to SEQ ID NO: 66337

SEQ ID NO: 66341 - protein, 407 aa, Homo sapiens
MDNVLPVDSDLSPNISTNTSEPNQFVQPAWQIVLWAAAYTVIVVTSVVGNVVVMWIILAHKRMRTVTNYFLVNLAFAEASMAAFNTVVNFTYAVHNEWYYGLFYCKFHNFFPIAAVFASIYSMTAVAFDRYMAIIHPLQPRLSATATKVVICVIWVLALLLAFPQGYYSTTETMPSRVVCMIEWPEHPNKIYEKVYHICVTVLIYFLPLLVIGYAYTVVGITLWASEIPGDSSDRYHEQVSAKRKVVKMMIVVVCTFAICWLPFHIFFLLPYINPDLYLKKFIQQVYLAIMWLAMSSTMYNPIIYCCLNDRFRLGFKHAFRCCPFISAGDYEGLEMKSTRYLQTQGSVYKVSRLETTISTVVGAHEEEPEDGPKATPSSLDLTSNCSSRSDSKTMTESFSFSSNVLS

SEQ ID NO: 66342 - protein, 311 aa, Homo sapiens
MDNVLPVDSDLSPNISTNTSEPNQFVQPAWQIVLWAAAYTVIVVTSVVGNVVVMWIILAHKRMRTVTNYFLVNLAFAEASMAAFNTVVNFTYAVHNEWYYGLFYCKFHNFFPIAAVFASIYSMTAVAFDRYMAIIHPLQPRLSATATKVVICVIWVLALLLAFPQGYYSTTETMPSRVVCMIEWPEHPNKIYEKVYHICVTVLIYFLPLLVIGYAYTVVGITLWASEIPGDSSDRYHEQVSAKRKVVKMMIVVVCTFAICWLPFHIFFLLPYINPDLYLKKFIQQVYLAIMWLAMSSTMYNPIIYCCLNDR

SEQ ID NO: 66343 - protein, 398 aa, Homo sapiens
MGTCDIVTEANISSGPESNTTGITAFSMPSWQLALWATAYLALVLVAVTGNAIVIWIILAHRRMRTVTNYFIVNLALADLCMAAFNAAFNFVYASHNIWYFGRAFCYFQNLFPITAMFVSIYSMTAIAADRYMAIVHPFQPRLSAPSTKAVIAGIWLVALALASPQCFYSTVTMDQGATKCVVAWPEDSGGKTLLLYHLVVIALIYFLPLAVMFVAYSVIGLTLWRRAVPGHQAHGANLRHLQAMKKFVKTMVLVVLTFAICWLPYHLYFILGSFQEDIYCHKFIQQVYLALFWLAMSSTMYNPIIYCCLNHRFRSGFRLAFRCCPWVTPTKEDKLELTPTTSLSTRVNRCHTKETLFMAGDTAPSEATSGEAGRPQDGSGLWFGYGLLAPTKTHVEI

SEQ ID NO: 66344 - protein, 186 aa, Homo sapiens
MFVAYSVIGLTLWRRAVPGHQAHGANLRHLQAMKKFVKTMVLVVLTFAICWLPYHLYFILGSFQEDIYCHKFIQQVYLALFWLAMSSTMYNPIIYCCLNHRFRSGFRLAFRCCPWVTPTKEDKLELTPTTSLSTRVNRCHTKETLFMAGDTAPSEATSGEAGRPQDGSGLWFGYGLLAPTKTHVEI

SEQ ID NO: 66345 - protein, 465 aa, Homo sapiens
MATLPAAETWIDGGGGVGADAVNLTASLAAGAATGAVETGWLQLLDQAGNLSSSPSALGLPVASPAPSQPWANLTNQFVQPSWRIALWSLAYGVVVAVAVLGNLIVIWIILAHKRMRTVTNYFLVNLAFSDASMAAFNTLVNFIYALHSEWYFGANYCRFQNFFPITAVFASIYSMTAIAVDRYMAIIDPLKPRLSATATKIVIGSIWILAFLLAFPQCLYSKTKVMPGRTLCFVQWPEGPKQHFTYHIIVIILVYCFPLLIMGITYTIVGITLWGGEIPGDTCDKYHEQLKAKRKVVKMMIIVVMTFAICWLPYHIYFILTAIYQQLNRWKYIQQVYLASFWLAMSSTMYNPIIYCCLNKRFRAGFKRAFRWCPFIKVSSYDELELKTTRFHPNRQSSMYTVTRMESMTVVFDPNDADTTRSSRKKRATPRDPSFNGCSRRNSKSASATSSFISSPYTSVDEYS

SEQ ID NO: 66346 - protein, 1893 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGVSENGEGIILPSIIAPSSLASEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 66347 - protein, 1872 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 66348 - protein, 543 aa, Homo sapiens
MTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQAKPPDLYDTNTSLSMSRDASVFQDESNMSVLDIPSATPEKQVTQMRQGRGRLGEEDSDVDIEGYDDEEEDGKPKTPAPEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISHQ

SEQ ID NO: 66349 - protein, 1895 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGVSENGEGIILPSIIAPSSLASEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQAKPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 66350 - protein, 1906 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQMRQGRGRLGEEDSDVDIEGYDDEEEDGKPKTPAPEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 66351 - protein, 298 aa, Homo sapiens
MTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGYMCTTCRF

SEQ ID NO: 66352 - protein, 218 aa, Homo sapiens
MSCSGSGADPEAAPASAASAPGPAPPVSAPAALPSSTAAENKASPAGTAGGPGAGAAAGGTGPLAARAGEPAERRGAAPVSAGGAAPPEGAISNGVYVLPSAANGDVKPVVSSTPLVDFLMQLEDYTPTIPDAVTGYYLNRAGFEASDPRIIRLISLAAQKFISDIANDALQHCKMKGTASGSSRSKSKDRKYTLTMEDLTPALSEYGINVKKPHYFT

SEQ ID NO: 66353 - protein, 211 aa, Homo sapiens
MDDAHESPSDKGGETGESDETAAVPGDPGATDTDGIPEETDGDADVDLKEAAAEEGELESQDVSDLTTVEREDSSLLNPAAKKLKIDTKEKKEKKQKVDEDEIQKMQILVSSFSEEQLNRYEMYRRSAFPKAAIKRLIQSITGTSVSQNVVIAMSGISKVFVGEVVEEALDVCEKWGEMPPLQPKHMREAVRRLKSKGQIPNSKHKKIIFF

SEQ ID NO: 66354 - protein, 154 aa, Homo sapiens
MDDAHESPSDKGGETGESDETAAVPGDPGATDTDGIPEETDGDADVDLKEAAAEEGELESQDVSDLTTVEREDSSLLNPAAKKLKIDTKEKKEKKQKVDEDEIQKMQILVSSFSEEQLNRYEMYRRSAFPKAAIKRHWMCVRSGEKCHHYNPNI

SEQ ID NO: 66355 - protein, 161 aa, Homo sapiens
MNQFGPSALINLSNFSSIKPEPASTPPQGSMANSTAVVKIPGTPGAGGRLSPENNQVLTKKKLQDLVREVDPNEQLDEDVEEMLLQIADDFIESVVTAACQLARHRKSSTLEVKDVQLHLERQWNMWIPGFGSEEIRPYKKACTTEAHKQRMALIRKTTKK

SEQ ID NO: 66356 - protein, 161 aa, Homo sapiens; identical to SEQ ID NO: 66355

SEQ ID NO: 66357 - protein, 592 aa, Homo sapiens
MSDSGSYGQSGGEQQSYSTYGNPGSQGYGQASQSYSGYGQTTDSSYGQNYSGYSSYGQSQSGYSQSYGGYENQKQSSYSQQPYNNQGQQQNMESSGSQGGRAPSYDQPDYGQQDSYDQQSGYDQHQGSYDEQSNYDQQHDSYSQNQQSYHSQRENYSHHTQDDRRDVSRYGEDNRGYGGSQGGGRGRGGYDKDGRGPMTGSSGGDRGGFKNFGGHRDYGPRTDADSESDNSDNNTIFVQGLGEGVSTDQVGEFFKQIGIIKTNKKTGKPMINLYTDKDTGKPKGEATVSFDDPPSAKAAIDWFDGKEFHGNIIKVSFATRRPEFMRGGGSGGGRRGRGGYRGRGGFQGRGGDPKSGDWVCPNPSCGNMNFARRNSCNQCNEPRPEDSRPSGGDFRGRGYGGERGYRGRGGRGGDRGGYGGDRSGGGYGGDRSSGGGYSGDRSGGGYGGDRSGGGYGGDRGGGYGGDRGGGYGGDRGGGYGGDRGGYGGDRGGGYGGDRGGYGGDRGGYGGDRGGYGGDRGGYGGDRSRGGYGGDRGGGSGYGGDRSGGYGGDRSGGGYGGDRGGGYGGDRGGYGGKMGGRNDYRNDQRNRPY

SEQ ID NO: 66358 - protein, 592 aa, Homo sapiens; identical to SEQ ID NO: 66357

SEQ ID NO: 66359 - protein, 395 aa, Homo sapiens
MTGSSGGDRGGFKNFGGHRDYGPRTDADSESDNSDNNTIFVQGLGEGVSTDQVGEFFKQIGIIKTNKKTGKPMINLYTDKDTGKPKGEATVSFDDPPSAKAAIDWFDGKEFHGNIIKVSFATRRPEFMRGGGSGGGRRGRGGYRGRGGFQGRGGDPKSGDWVCPNPSCGNMNFARRNSCNQCNEPRPEDSRPSGGDFRGRGYGGERGYRGRGGRGGDRGGYGGDRSGGGYGGDRSSGGGYSGDRSGGGYGGDRSGGGYGGDRGGGYGGDRGGGYGGDRGGGYGGDRGGYGGDRGGGYGGDRGGYGGDRGGYGGDRGGYGGDRGGYGGDRSRGGYGGDRGGGSGYGGDRSGGYGGDRSGGGYGGDRGGGYGGDRGGYGGKMGGRNDYRNDQRNRPY

SEQ ID NO: 66360 - protein, 929 aa, Homo sapiens
MCESYSRSLLRVSVAQICQALGWDSVQLSACHLLTDVLQRYLQQLGRGCHRYSELYGRTDPILDDVGEAFQLMGVSLHELEDYIHNIEPVTFPHQIPSFPVSKNNVLQFPQPGSKDAEERKEYIPDYLPPIVSSQEEEEEEQVPTDGGTSAEAMQVPLEEDDELEEEEIINDENFLGKRPLDSPEAEELPAMKRPRLLSTKGDTLDVVLLEAREPLSSINTQKIPPMLSPVHVQDSTDLAPPSPEPPMLAPVAKSQMPTAKPLETKSFTPKTKTKTSSPGQKTKSPKTAQSPAMVGSPIRSPKTVSKEKKSPGRSKSPKSPKSPKVTTHIPQTPVRPETPNRTPSATLSEKISKETIQVKQIQTPPDAGKLNSENQPKKAVVADKTIEASIDAVIARACAEREPDPFEFSSGSESEGDIFTSPKRISGPECTTPKASTSANNFTKSGSTPLPLSGGTSSSDNSWTMDASIDEVVRKAKLGTPSNMPPNFPYISSPSVSPPTPEPLHKVYEEKTKLPSSVEVKKKLKKELKTKMKKKEKQRDREREKDKNKDKSKEKDKVKEKEKDKETGRETKYPWKEFLKEEEADPYKFKIKEFEDVDPKVKLKDGLVRKEKEKHKDKKKDREKGKKDKDKREKEKVKDKGREDKMKAPAPPLVLPPKELALPLFSPATASRVPAMLPSLLPVLPEKLFEEKEKVKEKEKKKDKKEKKKKKEKEKEKKEKEREKEKREREKREKEKEKHKHEKIKVEPVALAPSPVIPRLTLRVGAGQDKIVISKVVPAPEAKPAPSQNRPKTPPPAPAPAPGPMLVSPAPVPLPLLAQAAAGPALLPSPGPAASGASAKAPVRSVVTETVSTYVIRDEWGNQIWICPGCNKPDDGSPMIGCDDCDDWYHWPCVGIMTAPPEEMQWFCPKCANKKKDKKHKKRKHRAH

SEQ ID NO: 66361 - protein, 283 aa, Homo sapiens
MCESYSRSLLRVSVAQICQALGWDSVQLSACHLLTDVLQRYLQQLGRGCHRYSELYGRTDPILDDVGEAFQLMGVSLHELEDYIHNIEPVTFPHQIPSFPVSKNNVLQFPQPGSKDAEERKEYIPDYLPPIVSSQEEEEEEQVPTDGGTSAEAMQVPLEEDDELEEEEIINDENFLGKRPLDSPEAEELPAMKRPRLLSTKGDTLDVVLLEAREPLSSINTQKIPPMLSPVHVQDSTDLAPPSPEPPMLAPVAKSQMPTAKPLETKSFTPKTKTKKKKKKKKS

SEQ ID NO: 66362 - protein, 1085 aa, Homo sapiens
MAAGSDLLDEVFFNSEVDEKVVSDLVGSLESQLAASAAHHHHLAPRTPEVRAAAAGALGNHVVSGSPAGAAGAGPAAPAEGAPGAAPEPPPAGRARPGGGGPQRPGPPSPRRPLVPAGPAPPAAKLRPPPEGSAGSCAPVPAAAAVAAGPEPAPAGPAKPAGPAALAARAGPGPGPGPGPGPGPGPGKPAGPGAAQTLNGSAALLNSHHAAAPAVSLVNNGPAALLPLPKPAAPGTVIQTPPFVGAAAPPAPAAPSPPAAPAPAAPAAAPPPPPPAPATLARPPGHPAGPPTAAPAVPPPAAAQNGGSAGAAPAPAPAAGGPAGVSGQPGPGAAAAAPAPGVKAESPKRVVQAAPPAAQTLAASGPASTAASMVIGPTMQGALPSPAAVPPPAPGTPTGLPKGAAGAVTQSLSRTPTATTSGIRATLTPTVLAPRLPQPPQNPTNIQNFQLPPGMVLVRSENGQLLMIPQQALAQMQAQAHAQPQTTMAPRPATPTSAPPVQISTVQAPGTPIIARQVTPTTIIKQVSQAQTTVQPSATLQRSPGVQPQLVLGGAAQTASLGTATAVQTGTPQRTVPGATTTSSAATETMENVKKCKNFLSTLIKLASSGKQSTETAANVKELVQNLLDGKIEAEDFTSRLYRELNSSPQPYLVPFLKRSLPALRQLTPDSAAFIQQSQQQPPPPTSQATTALTAVVLSSSVQRTAGKTAATVTSALQPPVLSLTQPTQVGVGKQGQPTPLVIQQPPKPGALIRPPQVTLTQTPMVALRQPHNRIMLTTPQQIQLNPLQPVPVVKPAVLPGTKALSAVSAQAAAAQKNKLKEPGGGSFRDDDDINDVASMAGVNLSEESARILATNSELVGTLTRSCKDETFLLQAPLQRRILEIGKKHGITELHPDVVSYVSHATQQRLQNLVEKISETAQQKNFSYKDDDRYEQASDVRAQLKFFEQLDQIEKQRKDEQEREILMRAAKSRSRQEDPEQLRLKQKAKEMQQQELAQMRQRDANLTALAAIGPRKKRKVDCPGPGSGAEGSGPGSVVPGSSGVGTPRQFTRQRITRVNLRDLIFCLENERETSHSLLLYKAFLK

SEQ ID NO: 66363 - protein, 949 aa, Homo sapiens
GRGLLQQRGGRESGPAPPAAKLRPPPEGSAGSCAPVPAAAAVAAGPEPAPAGPAKPAGPAALAARAGPGPGPGPGPGPGPGPGKPAGPGAAQTLNGSAALLNSHHAAAPAVSLVNNGPAALLPLPKPAAPAAAPPPPPPAPATLARPPGHPAGPPTAAPAVPPPAAAQNGGSAGAAPAPAPAAGGPAGVSGQPGPGAAAAAPAPGVKAESPKRVVQAAPPAAQTLAASGPASTAASMVIGPTMQGALPSPAAVPPPAPGTPTGLPKGAAGAVTQSLSRTPTATTSGIRATLTPTVLAPRLPQPPQNPTNIQNFQLPPGMVLVRSENGQLLMIPQQALAQMQAQAHAQPQTTMAPRPATPTSAPPVQISTVQAPGTPIIARQVTPTTIIKQVSQAQTTVQPSATLQRSPGVQPQLVLGGAAQTASLGTATAVQTGTPQRTVPGATTTSSAATETMENVKKCKNFLSTLIKLASSGKQSTETAANVKELVQNLLDGKIEAEDFTSRLYRELNSSPQPYLVPFLKRSLPALRQLTPDSAAFIQQSQQQPPPPTSQATTALTAVVLSSSVQRTAGKTAATVTSALQPPVLSLTQPTQVGVGKQGQPTPLVIQQPPKPGALIRPPQVTLTQTPMVALRQPHNRIMLTTPQQIQLNPLQPVPVVKPAVLPGTKALSAVSAQAAAAQKNKLKEPGGGSFRDDDDINDVASMAGVNLSEESARILATNSELVGTLTRSCKDETFLLQAPLQRRILEIGKKHGITELHPDVVSYVSHATQQRLQNLVEKISETAQQKNFSYKDDDRYEQASDVRAQLKFFEQLDQIEKQRKDEQEREILMRAAKSRSRQEDPEQLRLKQKAKEMQQQELAQMRQRDANLTALAAIGPRKKRKVDCPGPGSGAEGSGPGSVVPGSSGVGTPRQFTRQRITRVNLRDLIFCLENERETSHSLLLYKAFLK

SEQ ID NO: 66364 - protein, 862 aa, Homo sapiens
MPAGLTEPAGAAPPAAVSASGTVTMAPAGALPVRVESTPVALGAVTKAPVSVCVEPTASQPLRSPVGTLVTKVAPVSAPPKVSSGPRLPAPQIVAVKAPNTTTIQFPANLQLPPGTVLIKSNSGPLMLVSPQQTVTRAETTSNITSRPAVPANPQTVKICTVPNSSSQLIKKVAVTPVKKLAQIGTTVVTTVPKPSSVQSVAVPTSVVTVTPGKPLNTVTTLKPSSLGASSTPSNEPNLKAENSAAVQINLSPTMLENVKKCKNFLAMLIKLACSGSQSPEMGQNVKKLVEQLLDAKIEAEEFTRKLYVELKSSPQPHLVPFLKKSVVALRQLLPNSQSFIQQCVQQTSSDMVIATCTTTVTTSPVVTTTVSSSQSEKSIIVSGATAPRTVSVQTLNPLAGPVGAKAGVVTLHSVGPTAATGGTTAGTGLLQTSKPLVTSVANTVTTVSLQPEKPVVSGTAVTLSLPAVTFGETSGAAICLPSVKPVVSSAGTTSDKPVIGTPVQIKLAQPGPVLSQPAGIPQAVQVKQLVVQQPSGGNEKQVTTISHSSTLTIQKCGQKTMPVNTIIPTSQFPPASILKQITLPGNKILSLQASPTQKNRIKENVTSCFRDEDDINDVTSMAGVNLNEENACILATNSELVGTLIQSCKDEPFLFIGALQKRILDIGKKHDITELNSDAVNLISQATQERLRGLLEKLTAIAQHRMTTYKASENYILCSDTRSQLKFLEKLDQLEKQRKDLEEREMLLKAAKSRSNKEDPEQLRLKQKAKELQQLELAQIQHRDANLTALAAIGPRKKRPLESGIEGLKDNLLASGTSSLTATKQLHRPRITRICLRDLIFCMEQEREMKYSRALYLALLK

SEQ ID NO: 66365 - protein, 618 aa, Homo sapiens
MPAGLTEPAGAAPPAAVSASGTVTMAPAGALPVRVESTPVALGAVTKAPVSVCVEPTASQPLRSPVGTLVTKVAPVSAPPKVSSGPRLPAPQIVAVKAPNTTTIQFPANLQLPPGTVLIKSNSGPLMLVSPQQTVTRAETTSNITSRPAVPANPQTVKICTVPNSSSQLIKKVAVTPVKKLAQIGTTVVTTVPKPSSVQSVAVPTSVVTVTPGKPLNTVTTLKPSSLGASSTPSNEPNLKAENSAAVQINLSPTMLENVKKCKNFLAMLIKLACSGSQSPEMGQNVKKLVEQLLDAKIEAEEFTRKLYVELKSSPQPHLVPFLKKSVVALRQLLPNSQSFIQQCVQQTSSDMVIATCTTTVTTSPVVTTTVSSSQSEKSIIVSGATAPRTVSVQTLNPLAGPVGAKAGVVTLHSVGPTAATGGTTAGTGLLQTSKPLVTSVANTVTTVSLQPEKPVVSGTAVTLSLPAVTFGETSGAAICLPSVKPVVSSAGTTSDKPVIGTPVQIKLAQPGPVLSQPAGIPQAVQVKQLVVQQPSGGNEKQVTTISHSSTLTIQKCGQKTMPVNTIIPTSQFPPASILKQITLPGNKILSLQASPTQKNRIKENVTSCFRSTFICVY

SEQ ID NO: 66366 - protein, 865 aa, Homo sapiens
MPAGLTEPAGAAPPAAVSASGTVTMAPAGALPVRVESTPVALGAVTKAPVSVCVEPTASQPLRSPVGTLVTKVAPVSAPPKVSSGPRLPAPQIVAVKAPNTTTIQFPANLQLPPGTVLIKSNSGPLMLVSPQQTVTRAETTSNITSRPAVPANPQTVKICTVPNSSSQLIKKVAVTPVKKLAQIGTTVVTTVPKPSSVQSVAVPTSVVTVTPGKPLNTVTTLKPSSLGASSTPSNEPNLKAENSAAVQINLSPTMLENVKKCKNFLAMLIKLACSGSQSPEMGQNVKKLVEQLLDAKIEAEEFTRKLYVELKSSPQPHLVPFLKKSVVALRQLLPNSQSFIQQCVQQTSSDMVIATCTTTVTTSPVVTTTVSSSQSEKSIIVSGATAPRTVSVQTLNPLAGPVGAKAGVVTLHSVGPTAATGGTTAGTGLLQTSKPLVTSVANTVTTVSLQPEKPVVSGTAVTLSLPAVTFGETSGAAICLPSVKPVVFCWDHIKPVIGTPVQIKLAQPGPVLSQPAGIPQAVQVKQLFSLFQVVQQPSGGNEKQVTTISHSSTLTIQKCGQKTMPVNTIIPTSQFPPASILKQITLPGNKILSLQASPTQKNRIKENVTSCFRDEDDINDVTSMAGVNLNEENACILATNSELVGTLIQSCKDEPFLFIGALQKRILDIGKKHDITELNSDAVNLISQATQERLRGLLEKLTAIAQHRMTTYKASENYILCSDTRSQLKFLEKLDQLEKQRKDLEEREMLLKAAKSRSNKEDPEQLRLKQKAKELQQLELAQIQHRDANLTALAAIGPRKKRPLESGIEGLKDNLLASGTSSLTATKQLHRPRITRICLRDLIFCMEQEREMKYSRALYLALLK

SEQ ID NO: 66367 - protein, 745 aa, Homo sapiens
MAALAEEQTEVAVKLEPEGPPTLLPPQAGDGAGEGSGGTTNNGPNGGGGNVAASSSTGGDGGTPKPTVAVSAAAPAGAAPVPAAAPDAGAPHDRQTLLAVLQFLRQSKLREAEEALRREAGLLEEAVAGSGAPGEVDSAGAEVTSALLSRVTASAPGPAAPDPPGTGASGATVVSGSASGPAAPGKVGSVAVEDQPDVSAVLSAYNQQGDPTMYEEYYSGLKHFIECSLDCHRAELSQLFYPLFVHMYLELVYNQHENEAKSFFEKFHGDQECYYQDDLRVLSSLTKKEHMKGNETMLDFRTSKFVLRISRDSYQLLKRHLQEKQNNQIWNIVQEHLYIDIFDGMPRSKQQIDAMVGSLAGEAKREANKSKVFFGLLKEPEIEVPLDDEDEEGENEEGKPKKKKPKKDSIGSKSKKQDPNAPPQNRIPLPELKDSDKLDKIMNMKETTKRVRLGPDCLPSICFYTFLNAYQGLTAVDVTDDSSLIAGGFADSTVRVWSVTPKKLRSVKQASDLSLIDKESDDVLERIMDEKTASELKILYGHSGPVYGASFSPDRLWATDHYQPLRIFAGHLADVNCTRFHPNSNYVATGSADRTVRLWDVLNGNCVRIFTGHKGPIHSLTFSPNGRFLATGATDGRVLLWDIGHGLMVGELKGHTDTVCSLRFSRDGEILASGSMDNTVRLWDAIKAFEDLETDDFTTATGHINLPENSQELLLGTYMTKSTPVVHLHFTRRNLVLAAGAYSPQ

SEQ ID NO: 66368 - protein, 800 aa, Homo sapiens
MAALAEEQTEVAVKLEPEGPPTLLPPQAGDGAGEGSGGTTNNGPNGGGGNVAASSSTGGDGGTPKPTVAVSAAAPAGAAPVPAAAPDAGAPHDRQTLLAVLQFLRQSKLREAEEALRREAGLLEEAVAGSGAPGEVDSAGAEVTSALLSRVTASAPGPAAPDPPGTGASGATVVSGSASGPAAPGKVGSVAVEDQPDVSAVLSAYNQQGDPTMYEEYYSGLKHFIECSLDCHRAELSQLFYPLFVHMYLELVYNQHENEAKSFFEKFHGDQECYYQDDLRVLSSLTKKEHMKGNETMLDFRTSKFVLRISRDSYQLLKRHLQEKQNNQIWNIVQEHLYIDIFDGMPRSKQQIDAMVGSLAGEAKREANKSKVFFGLLKEPEIEVPLDDEDEEGENEEGKPKKKKPKKDSIGSKSKKQDPNAPPQNRIPLPELKDSDKLDKIMNMKETTKRVRLGPDCLPSICFYTFLNAYQGLTAVDVTDDSSLIAGGFADSTVRVWSVTPKKLRSVKQASDLSLIDKESDDVLERIMDEKTASELKILYGHSGPVYGASFSPDRNYLLSSSEDGTVRLWSLQTFTCLVGYKGHNYPVWDTQFSPYGYYFVSGGHDRVARLWATDHYQPLRIFAGHLADVNCTRFHPNSNYVATGSADRTVRLWDVLNGNCVRIFTGHKGPIHSLTFSPNGRFLATGATDGRVLLWDIGHGLMVGELKGHTDTVCSLRFSRDGEILASGSMDNTVRLWDAIKAFEDLETDDFTTATGHINLPENSQELLLGTYMTKSTPVVHLHFTRRNLVLAAGAYSPQ

SEQ ID NO: 66369 - protein, 677 aa, Homo sapiens
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAHWLSIEGCQPAIPENPPPAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPGLYQMLPRFSTFISEGVRVNVVQNNLALLIYLMRMVKALMDNPTLYLEKYVHELIPAVMTCIVSRQLCLRPDVDNHWALRDFAARLVAQICKHFSTTTNNIQSRITKTFTKSWVDEKTPWTTRYGSIAGLAELGHDVIKTLILPRLQQEGERIRSVLDGPVLSNIDRIGADHVQSLLLKHCAPVLAKLRPPPDNQDAYRAEFGSLGPLLCSQVVKARAQAALQAQQVNRTTLTITQPRPTLTLSQAPQPGPRTPGLLKVPGSIALPVQTLVSARAAAPPQPSPPPTKFIVMSSSSSAPSTQQVLSLSTSAPGSGSTTTSPVTTTVPSVQPIVKLVSTATTAPPSTAPSGPGSVQKYIVVSLPPTGEGKGGPTSHPSPVPPPASSPSPLSGSALCGGKQEAGDSPPPAPGTPKANGSQPNSGSPQPAP

SEQ ID NO: 66370 - protein, 76 aa, Homo sapiens
MAEEKKLKLSNTVLPSESMKVVAESMGIAQIQEETCQLLTDEVSYRIKEIAQDALKFMHMGKRQKLTTSDIDYALK

SEQ ID NO: 66371 - protein, 601 aa, Homo sapiens
MHMGKRQKLTTSDIDYALKLKNVEPLYGFHAQEFIPFRFASGGGRELYFYEEKEVDLSDIINTPLPRVPLDVCLKAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPGLYQMLPRFSTFISEGVRVNVVQNNLALLIYLMRMVKALMDNPTLYLEKYVHELIPAVMTCIVSRQLCLRPDVDNHWALRDFAARLVAQICKHFSTTTNNIQSRITKTFTKSWVDEKTPWTTRYGSIAGLAELGHDVIKTLILPRLQQEGERIRSVLDGPVLSNIDRIGADHVQSLLLKHCAPVLAKLRPPPDNQDAYRAEFGSLGPLLCSQVVKARAQAALQAQQVNRTTLTITQPRPTLTLSQAPQPGPRTPGLLKVPGSIALPVQTLVSARAAAPPQPSPPPTKFIVMSSSSSAPSTQQVLSLSTSAPGSGSTTTSPVTTTVPSVQPIVKLVSTATTAPPSTAPSGPGSVQKYIVVSLPPTGEGKGGPTSHPSPVPPPASSPSPLSGSALCGGKQEAGDSPPPAPGTPKANGSQPNSGSPQPAP

SEQ ID NO: 66372 - protein, 14 aa, Homo sapiens
MAEEKKLKLSNTVL

SEQ ID NO: 66373 - protein, 714 aa, Homo sapiens
MTKRRLQTITACLQLREGSPSLHRGLHPSREEKRDSRMAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAHWLSIEGCQPAIPENPPPAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPGLYQMLPRFSTFISEGVRVNVVQNNLALLIYLMRMVKALMDNPTLYLEKYVHELIPAVMTCIVSRQLCLRPDVDNHWALRDFAARLVAQICKHFSTTTNNIQSRITKTFTKSWVDEKTPWTTRYGSIAGLAELGHDVIKTLILPRLQQEGERIRSVLDGPVLSNIDRIGADHVQSLLLKHCAPVLAKLRPPPDNQDAYRAEFGSLGPLLCSQVVKARAQAALQAQQVNRTTLTITQPRPTLTLSQAPQPGPRTPGLLKVPGSIALPVQTLVSARAAAPPQPSPPPTKFIVMSSSSSAPSTQQVLSLSTSAPGSGSTTTSPVTTTVPSVQPIVKLVSTATTAPPSTAPSGPGSVQKYIVVSLPPTGEGKGGPTSHPSPVPPPASSPSPLSGSALCGGKQEAGDSPPPAPGTPKANGSQPNSGSPQPAP

SEQ ID NO: 66374 - protein, 233 aa, Homo sapiens
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPGL

SEQ ID NO: 66375 - protein, 134 aa, Homo sapiens
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAH

SEQ ID NO: 66376 - protein, 114 aa, Homo sapiens
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDL

SEQ ID NO: 66377 - protein, 677 aa, Homo sapiens; identical to SEQ ID NO: 66369

SEQ ID NO: 66378 - protein, 677 aa, Homo sapiens; identical to SEQ ID NO: 66369

SEQ ID NO: 66379 - protein, 9 aa, Homo sapiens
MAEEKKLKL

SEQ ID NO: 66380 - protein, 734 aa, Homo sapiens
MDIRHSEFLPCLHCPPFVGPLPVSHVSFSSACPVPLPGSPSLHRGLHPSREEKRDSRMAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAHWLSIEGCQPAIPENPPPAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPGLYQMLPRFSTFISEGVRVNVVQNNLALLIYLMRMVKALMDNPTLYLEKYVHELIPAVMTCIVSRQLCLRPDVDNHWALRDFAARLVAQICKHFSTTTNNIQSRITKTFTKSWVDEKTPWTTRYGSIAGLAELGHDVIKTLILPRLQQEGERIRSVLDGPVLSNIDRIGADHVQSLLLKHCAPVLAKLRPPPDNQDAYRAEFGSLGPLLCSQVVKARAQAALQAQQVNRTTLTITQPRPTLTLSQAPQPGPRTPGLLKVPGSIALPVQTLVSARAAAPPQPSPPPTKFIVMSSSSSAPSTQQVLSLSTSAPGSGSTTTSPVTTTVPSVQPIVKLVSTATTAPPSTAPSGPGSVQKYIVVSLPPTGEGKGGPTSHPSPVPPPASSPSPLSGSALCGGKQEAGDSPPPAPGTPKANGSQPNSGSPQPAP

SEQ ID NO: 66381 - protein, 255 aa, Homo sapiens
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAHWLSIEGCQPAIPENPPPAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPGLYQM

SEQ ID NO: 66382 - protein, 349 aa, Homo sapiens
MSKSKDDAPHELESQFILRLPPEYASTVRRAVQSGHVNLKDRLTIELHPDGRHGIVRVDRVPLASKLVDLPCVMESLKTIDKKTFYKTADICQMLVSTVDGDLYPPVEEPVASTDPKASKKKDKDKEKKFIWNHGITLPLKNVRKRRFRKTAKKKYIESPDVEKEVKRLLSTDAEAVSTRWEIIAEDETKEAENQGLDISSPGMSGHRQGHDSLEHDELREIFNDLSSSSEDEDETQHQDEEDINIIDTEEDLERQLQDKLNESDEQHQENEGTNQLVMGIQKQIDNMKGKLQETQDRAKRQEDLIMKVENLALKNRFQAVLDELKQKEDREKEQLSSLQEELESLLEK

SEQ ID NO: 66383 - protein, 302 aa, Homo sapiens
MSESQDEVPDEVENQFILRLPLEHACTVRNLARSQSVKMKDKLKIDLLPDGRHAVVEVEDVPLAAKLVDLPCVIESLRTLDKKTFYKTADISQMLVCTADGDIHLSPEEPAASTDPNIVRKKERGREEKCVWKHGITPPLKNVRKKRFRKTQKKVPDVKEMEKSSFTEYIESPDVENEVKRLLRSDAEAVSTRWEVIAEDGTKEIESQGSIPGFLISSGMSSHKQGHTSSVMEIQKQIEKKEKKLHKIQNKAQRQKDLIMKVENLTLKNHFQSVLEQLELQEKQKNEKLISLQEQLQRFLKK

SEQ ID NO: 66384 - protein, 376 aa, Homo sapiens
MSESQDEVPDEVENQFILRLPLEHACTVRNLARSQSVKMKDKLKIDLLPDGRHAVVEVEDVPLAAKLVDLPCVIESLRTLDKKTFYKTADISQMLVCTADGDIHLSPEEPAASTDPNIVRKKERGREEKCVWKHGITPPLKNVRKKRFRKTQKKVPDVKEMEKSSFTEYIESPDVENEVKRLLRSDAEAVSTRWEVIAEDGTKEIESQGSIPGFLISSGMSSHKQGHTSSEYDMLREMFSDSRSNNDDDEDEDDEDEDEDEDEDEDEDKEEEEEDCSEEYLERQLQAEFIESGQYRANEGTSSIVMEIQKQIEKKEKKLHKIQNKAQRQKDLIMKVENLTLKNHFQSVLEQLELQEKQKNEKLISLQEQLQRFLKK

SEQ ID NO: 66385 - protein, 302 aa, Homo sapiens; identical to SEQ ID NO: 66383

SEQ ID NO: 66386 - protein, 462 aa, Homo sapiens
MECPEGQLPISSENDSTPTVSTSEVTSQQEPQILVDRGSETTYESSADIAGDEGTQIPADEDTQTDADSSAQAAAQAPENFQEGKDMSESQDEVPDEVENQFILRLPLEHACTVRNLARSQSVKMKDKLKIDLLPDGRHAVVEVEDVPLAAKLVDLPCVIESLRTLDKKTFYKTADISQMLVCTADGDIHLSPEEPAASTDPNIVRKKERGREEKCVWKHGITPPLKNVRKKRFRKTQKKVPDVKEMEKSSFTEYIESPDVENEVKRLLRSDAEAVSTRWEVIAEDGTKEIESQGSIPGFLISSGMSSHKQGHTSSEYDMLREMFSDSRSNNDDDEDEDDEDEDEDEDEDEDEDKEEEEEDCSEEYLERQLQAEFIESGQYRANEGTSSIVMEIQKQIEKKEKKLHKIQNKAQRQKDLIMKVENLTLKNHFQSVLEQLELQEKQKNEKLISLQEQLQRFLKK

SEQ ID NO: 66387 - protein, 264 aa, Homo sapiens
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQKKASTSAGRITVPRLSVGSVTSRPSTPTLGTPTPQTMSVSTKVGTPMSLTGQRFTVQMPTSQSPAVKASIPATSAVQNVLINPSLIGSKNILITTNMMSSQNTANESSNALKRKREDDDDDDDDDDDYDNL

SEQ ID NO: 66388 - protein, 264 aa, Homo sapiens; identical to SEQ ID NO: 66387

SEQ ID NO: 66389 - protein, 169 aa, Homo sapiens
MCHRKPGTPGVGKTTLGKELASKSGLKYINVGDLAREEQLYDGYDEEYDCPILDEDRVVDELDNQMREGGVIVDYHGCDFFPERWFHIVFVLRTDTNVLYERLETRGYNEKKLTDNIQCEIFQVLYEEATASYKEEIVHQLPSNKPEELENNVDQILKWIEQWIKDHNS

SEQ ID NO: 66390 - protein, 172 aa, Homo sapiens
MLLPNILLTGTPGVGKTTLGKELASKSGLKYINVGDLAREEQLYDGYDEEYDCPILDEDRVVDELDNQMREGGVIVDYHGCDFFPERWFHIVFVLRTDTNVLYERLETRGYNEKKLTDNIQCEIFQVLYEEATASYKEEIVHQLPSNKPEELENNVDQILKWIEQWIKDHNS

SEQ ID NO: 66391 - protein, 198 aa, Homo sapiens
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQKKASTSAGRITVPRLSVGSVTSRPSTPTLGTPTPQTMSVSTKVGTPMSLTGQRFTVQMPTSQSPA

SEQ ID NO: 66392 - protein, 136 aa, Homo sapiens
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQKKA

SEQ ID NO: 66393 - protein, 264 aa, Homo sapiens; identical to SEQ ID NO: 66387

SEQ ID NO: 66394 - protein, 102 aa, Homo sapiens
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQT

SEQ ID NO: 66395 - protein, 166 aa, Homo sapiens
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQKKASTSAGRITVPRLSVGSVTSRPSTPTLGTPT

SEQ ID NO: 66396 - protein, 127 aa, Homo sapiens
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNY

SEQ ID NO: 66397 - protein, 251 aa, Homo sapiens
MESGKMAPPKNAPRDALVMAQILKDMGITEYEPRVINQMLEFAFRYVTTILDDAKIYSSHAKKPNVDADDVRLAIQCRADQSFTSPPPRDFLLDIARQKNQTPLPLIKPYAGPRLPPDRYCLTAPNYRLKSLIKKGPNQGRLVPRLSVGAVSSKPTTPTIATPQTVSVPNKVATPMSVTSQRFTVQIPPSQSTPVKPVPATTAVQNVLINPSMIGPKNILITTNMVSSQNTANEANPLKRKHEDDDDNDIM

SEQ ID NO: 66398 - protein, 292 aa, Homo sapiens
MPLHVKWPFPAVPPLTWTLASSVVMGLVGTYSCFWTKYMNHLTVHNREVLYELIEKRGPATPLITVSNHQSCMDDPHLWGILKLRHIWNLKLMRWTPAAADICFTKELHSHFFSLGKCVPVCRGAEFFQAENEGKGVLDTGRHMPGAGKRREKGDGVYQKGMDFILEKLNHGDWVHIFPEGKVNMSSEFLRFKWGIGRLIAECHLNPIILPLWHVGMNDVLPNSPPYFPRFGQKITVLIGKPFSALPVLERLRAENKSAVEMRKALTDFIQEEFQHLKTQAEQLHNHLQPGR

SEQ ID NO: 66399 - protein, 262 aa, Homo sapiens
MPLHVKWPFPAVPPLTWTLASSVVMGLVGTYSCFWTKYMNHLTVHNREVLYELIEKRGPATPLITVSNHQSCMDDPHLWGILKLRHIWNLKLMRWTPAAADICFTKELHSHFFSLGKCVPVCRGDGVYQKGMDFILEKLNHGDWVHIFPEGKVNMSSEFLRFKWGIGRLIAECHLNPIILPLWHVGMNDVLPNSPPYFPRFGQKITVLIGKPFSALPVLERLRAENKSAVEMRKALTDFIQEEFQHLKTQAEQLHNHLQPGR

SEQ ID NO: 66400 - protein, 278 aa, Homo sapiens
MPLHVKWPFPAVPPLTWTLASSVVMGLVGTYSCFWTKYMNHLTVHNREVLYELIEKRGPATPLITVSNHQSCMDDPHLWGILKLRHIWNLKLMRWTPAAADICFTKELHSHFFSLGKCVPVCRGAEFFQAENEGKGVLDTGRHMPGAGKRREKGDGVYQKGMDFILEKLNHGDWVHIFPEGIGRLIAECHLNPIILPLWHVGMNDVLPNSPPYFPRFGQKITVLIGKPFSALPVLERLRAENKSAVEMRKALTDFIQEEFQHLKTQAEQLHNHLQPGR

SEQ ID NO: 66401 - protein, 248 aa, Homo sapiens
MPLHVKWPFPAVPPLTWTLASSVVMGLVGTYSCFWTKYMNHLTVHNREVLYELIEKRGPATPLITVSNHQSCMDDPHLWGILKLRHIWNLKLMRWTPAAADICFTKELHSHFFSLGKCVPVCRGDGVYQKGMDFILEKLNHGDWVHIFPEGIGRLIAECHLNPIILPLWHVGMNDVLPNSPPYFPRFGQKITVLIGKPFSALPVLERLRAENKSAVEMRKALTDFIQEEFQHLKTQAEQLHNHLQPGR

SEQ ID NO: 66402 - protein, 265 aa, Homo sapiens
MPLHVKWPFPAVPPLTWTLASSVVMGLVGTYSCFWTKYMNHLTVHNREVLYELIEKRGPATPLITVSNHQSCMDDPHLWGILKLRHIWNLKLMRWTPAAADICFTKELHSHFFSLGKCVPVCRGAEFFQAENEGKGVLDTGRHMPGAGKRREKGKVNMSSEFLRFKWGIGRLIAECHLNPIILPLWHVGMNDVLPNSPPYFPRFGQKITVLIGKPFSALPVLERLRAENKSAVEMRKALTDFIQEEFQHLKTQAEQLHNHLQPGR

SEQ ID NO: 66403 - protein, 2542 aa, Homo sapiens
MVALSLKICVRHCNVVKTMQFEPSTAVYDACRVIRERVPEAQTGQASDYGLFLSDEDPRKGIWLEAGRTLDYYMLRNGDILEYKKKQRPQKIRMLDGSVKTVMVDDSKTVGELLVTICSRIGITNYEEYSLIQETIEEKKEEGTGTLKKDRTLLRDERKMEKLKAKLHTDDDLNWLDHSRTFREQGVDENETLLLRRKFFYSDQNVDSRDPVQLNLLYVQARDDILNGSHPVSFEKACEFGGFQAQIQFGPHVEHKHKPGFLDLKEFLPKEYIKQRGAEKRIFQEHKNCGEMSEIEAKVKYVKLARSLRTYGVSFFLVKEKMKGKNKLVPRLLGITKDSVMRVDEKTKEVLQEWPLTTVKRWAASPKSFTLDFGEYQESYYSVQTTEGEQISQLIAGYIDIILKKKQSKDRFGLEGDEESTMLEESVSPKKSTILQQQFNRTGKAEHGSVALPAVMRSGSSGPETFNVGSMPSPQQQVMVGQMHRGHMPPLTSAQQALMGTINTSMHAVQQAQDDLSELDSLPPLGQDMASRVWVQNKVDESKHEIHSQVDAITAGTASVVNLTAGDPADTDYTAVGCAITTISSNLTEMSKGVKLLAALMDDEVGSGEDLLRAARTLAGAVSDLLKAVQPTSGEPRQTVLTAAGSIGQASGDLLRQIGENETDERFQDVLMSLAKAVANAAAMLVLKAKNVAQVAEDTVLQNRVIAAATQCALSTSQLVACAKVVSPTISSPVCQEQLIEAGKLVDRSVENCVRACQAATTDSELLKQVSAAASVVSQALHDLLQHVRQFASRGEPIGRYDQATDTIMCVTESIFSSMGDAGEMVRQARVLAQATSDLVNAMRSDAEAEIDMENSKKLLAAAKLLADSTARMVEAAKGAAANPENEDQQQRLREAAEGLRVATNAAAQNAIKKKIVNRLEVAAKQAAAAATQTIAASQNAAVSNKNPAAQQQLVQSCKAVADHIPQLVQGVRGSQAQAEDLSAQLALIISSQNFLQPGSKMVSSAKAAVPTVSDQAAAMQLSQCAKNLATSLAELRTASQKAHEACGPMEIDSALNTVQTLKNELQDAKMAAVESQLKPLPGETLEKCAQDLGSTSKAVGSSMAQLLTCAAQGNEHYTGVAARETAQALKTLAQAARGVAASTTDPAAAHAMLDSARDVMEGSAMLIQEAKQALIAPGDAERQQRLAQVAKAVSHSLNNCVNCLPGQKDVDVALKSIGESSKKLLVDSLPPSTKPFQEAQSELNQAAADLNQSAGEVVHATRGQSGELAAASGKFSDDFDEFLDAGIEMAGQAQTKEDQIQVIGNLKNISMASSKLLLAAKSLSVDPGAPNAKNLLAAAARAVTESINQLITLCTQQAPGQKECDNALRELETVKGMLDNPNEPVSDLSYFDCIESVMENSKVLGESMAGISQNAKTGDLPAFGECVGIASKALCGLTEAAAQAAYLVGISDPNSQAGHQGLVDPIQFARANQAIQMACQNLVDPGSSPSQVLSAATIVAKHTSALCNACRIASSKTANPVAKRHFVQSAKEVANSTANLVKTIKALDGDFSEDNRNKCRIATAPLIEAVENLTAFASNPEFVSIPAQISSEGSQAQEPILVSAKTMLESSSYLIRTARSLAINPKDPPTWSVLAGHSHTVSDSIKSLITSIRDKAPGQRECDYSIDGINRCIRDIEQASLAAVSQSLATRDDISVEALQEQLTSVVQEIGHLIDPIATAARGEAAQLGHKVTQLASYFEPLILAAVGVASKILDHQQQMTVLDQTKTLAESALQMLYAAKEGGGNPKAQHTHDAITEAAQLMKEAVDDIMVTLNEAASEVGLVGGMVDAIAEAMSKLDEGTPPEPKGTFVDYQTTVVKYSKAIAVTAQEMMTKSVTNPEELGGLASQMTSDYGHLAFQGQMAAATAEPEEIGFQIRTRVQDLGHGCIFLVQKAGALQVCPTDSYTKRELIECARAVTEKVSLVLSALQAGNKGTQACITAATAVSGIIADLDTTIMFATAGTLNAENSETFADHRENILKTAKALVEDTKLLVSGAASTPDKLAQAAQSSAATITQLAEVVKLGAASLGSDDPETQVVLINAIKDVAKALSDLISATKGAASKPVDDPSMYQLKGAAKVMVTNVTSLLKTVKAVEDEATRGTRALEATIECIKQELTVFQSKDVPEKTSSPEESIRMTKGITMATAKAVAAGNSCRQEDVIATANLSRKAVSDMLTACKQASFHPDVSDEVRTRALRFGTECTLGYLDLLEHVLVILQKPTPEFKQQLAAFSKRVAGAVTELIQAAEAMKGTEWVDPEDPTVIAETELLGAAASIEAAAKKLEQLKPRAKPKQADETLDFEEQILEAAKSIAAATSALVKSASAAQRELVAQGKVGSIPANAADDGQWSQGLISAARMVAAATSSLCEAANASVQGHASEEKLISSAKQVAASTAQLLVACKVKADQDSEAMRRLQAAGNAVKRASDNLVRAAQKAAFGKADDDDVVVKTKFVGGIAQIIAAQEEMLKKERELEEARKKLAQIRQQQYKFLPTELREDEG

SEQ ID NO: 66404 - protein, 2542 aa, Homo sapiens; identical to SEQ ID NO: 66403

SEQ ID NO: 66405 - protein, 1729 aa, Homo sapiens
MKVSTLRESSAMASPLPREMEEELVPTGSEPGDTRAKPPVKPKPRALPAKPALPAKPSLLVPVGPRPPRGPLAELPSARKMNMLAGPQPYGGSKRPLPFAPRPAVEASTGGEATQETGKEEAGKEEPPPLTPPARCAAPGGVRKAPAPFRPASERFAATTVEEILAKMEQPRKEVLASPDRLWGSRLTFNHDGSSRYGPRTYGTTTAPRDEDGSTLFRGWSQEGPVKSPAECREEHSKTPEERSLPSDLAFNGDLAKAASSELPADISKPWIPSSPAPSSENGGPASPGLPAEASGSGPGSPHLHPPDKSSPCHSQLLEAQTPEASQASPCPAVTPSAPSAALPDEGSRHTPSPGLPAEGAPEAPRPSSPPPEVLEPHSLDQPPATSPRPLIEVGELLDLTRTFPSGGEEEAKGDAHLRPTSLVQRRFSEGVLQSPSQDQEKLGGSLAALPQGQGSQLALDRPFGAESNWSLSQSFEWTFPTRPSGLGVWRLDSPPPSPITEASEAAEAAEAGNLAVSSREEGVSQQGQGAGSAPSGSGSSWVQGDDPSMSLTQKGDGESQPQFPAVPLEPLPTTEGTPGLPLQQAEERYESQEPLAGQESPLPLATREAALPILEPVLGQEQPAAPDQPCVLFADAPEPGQALPVEEEAVTLARAETTQARTEAQDLCRASPEPPGPESSSRWLDDLLASPPPSGGGARRGAGAELKDTQSPSTCSEGLLGWSQKDLQSEFGITGDPQPSSFSPSSWCQGASQDYGLGGASPRGDPGLGERDWTSKYGQGAGEGSTREWASRCGIGQEEMEASSSQDQSKVSAPGVLTAQDRVVGKPAQLGTQRSQEADVQDWEFRKRDSQGTYSSRDAELQDQEFGKRDSLGTYSSRDVSLGDWEFGKRDSLGAYASQDANEQGQDLGKRDHHGRYSSQDADEQDWEFQKRDVSLGTYGSRAAEPQEQEFGKSAWIRDYSSGGSSRTLDAQDRSFGTRPLSSGFSPEEAQQQDEEFEKKIPSVEDSLGEGSRDAGRPGERGSGGLFSPSTAHVPDGALGQRDQSSWQNSDASQEVGGHQERQQAGAQGPGSADLEDGEMGKRGWVGEFSLSVGPQREAAFSPGQQDWSRDFCIEASERSYQFGIIGNDRVSGAGFSPSSKMEGGHFVPPGKTTAGSVDWTDQLGLRNLEVSSCVGSGGSSEARESAVGQMGWSGGLSLRDMNLTGCLESGGSEEPGGIGVGEKDWTSDVNVKSKDLAEVGEGGGHSQARESGVGQTDWSGVEAGEFLKSRERGVGQADWTPDLGLRNMAPGAVCSPGESKELGVGQMDWGNNLGLRDLEVTCDPDSGGSQGLRGCGVGQMDWTQDLAPQNVELFGAPSEAREHGVGGVSQCPEPGLRHNGSLSPGLEARDPLEARELGVGETSGPETQGEDYSSSSLEPHPADPGMETGEALSFGASPGRCPARPPPSGSQGLLEEMLAASSSKAVARRESAASGLGGLLEEEGAGAGAAQEEVLEPGRDSPPSWRPQPDGEASQTEDVDGTWGSSAARWSDQGPAQTSRRPSQGPPARSPSQDFSFIEDTEILDSAMYRSRANLGRKRGHRAPVIRPGGTLGLSEAADSDAHLFQDSTEPRASRVPSSDEEVVEEPQSRRTRMSLGTKGLKVNLFPGLSPSALKAKLRPRNRSAEEGELAESKSSQKESAVQRSKSCKVPGLGKPLTLPPKPEKSSGSEGSSPNWLQALKLKKKKV

SEQ ID NO: 66406 - protein, 143 aa, Homo sapiens
MKVSTLRESSAMASPLPREMEEELVPTGSEPGDTRAKPPVKPKPRALPAKPALPAKPSLLVPVGPRPPRGPLAELPSARKMNMLAGPQPYGGSKRPLPFAPRPAVEASTGGEATQETGKEEAGKEEPPPLTPPARCAAPGGVR

SEQ ID NO: 66407 - protein, 1729 aa, Homo sapiens; identical to SEQ ID NO: 66405

SEQ ID NO: 66408 - protein, 1001 aa, Homo sapiens
MPSTNRAGSLKDPEIAELFFKEDPEKLFTDLREIGHGSFGAVYFARDVRTNEVVAIKKMSYSGKQSTEKWQDIIKEVKFLQRIKHPNSIEYKGCYLREHTAWLVMEYCLGSASDLLEVHKKPLQEVEIAAITHGALQGLAYLHSHTMIHRDIKAGNILLTEPGQVKLADFGSASMASPANSFVGTPYWMAPEVILAMDEGQYDGKVDVWSLGITCIELAERKPPLFNMNAMSALYHIAQNESPTLQSNEWSDYFRNFVDSCLQKIPQDRPTSEELLKHIFVLRERPETVLIDLIQRTKDAVRELDNLQYRKMKKLLFQEAHNGPAVEAQEEEEEQDHGVGRTGTVNSVGSNQSIPSMSISASSQSSSVNSLPDVSDDKSELDMMEGDHTVMSNSSVIHLKPEEENYREEGDPRTRASDPQSPPQVSRHKSHYRNREHFATIRTASLVTRQMQEHEQDSELREQMSGYKRMRRQHQKQLMTLENKLKAEMDEHRLRLDKDLETQRNNFAAEMEKLIKKHQAAMEKEAKVMSNEEKKFQQHIQAQQKKELNSFLESQKREYKLRKEQLKEELNENQSTPKKEKQEWLSKQKENIQHFQAEEEANLLRRQRQYLELECRRFKRRMLLGRHNLEQDLVREELNKRQTQKDLEHAMLLRQHESMQELEFRHLNTIQKMRCELIRLQHQTELTNQLEYNKRRERELRRKHVMEVRQQPKSLKSKELQIKKQFQDTCKIQTRQYKALRNHLLETTPKSEHKAVLKRLKEEQTRKLAILAEQYDHSINEMLSTQALRLDEAQEAECQVLKMQLQQELELLNAYQSKIKMQAEAQHDRELRELEQRVSLRRALLEQKIEEEMLALQNERTERIRSLLERQAREIEAFDSESMRLGFSNMVLSNLSPEAFSHSYPGASGWSHNPTGGPGPHWGHPMGGPPQAWGHPMQGGPQPWGHPSGPMQGVPRGSSMGVRNSPQALRRTASGGRTEQGMSRSTSVTSQISNGSHMSYT

SEQ ID NO: 66409 - protein, 853 aa, Homo sapiens
MPSTNRAGSLKDPEIAELFFKEDPEKLFTDLREIGHGSFGAVYFARDVRTNEVVAIKKMSYSGKQSTEKWQDIIKEVKFLQRIKHPNSIEYKGCYLREHTAWLVMEYCLGSASDLLEVHKKPLQEVEIAAITHGALQGLAYLHSHTMIHRDIKAGNILLTEPGQVKLADFGSASMASPANSFVGTPYWMAPEVILAMDEGQYDGKVDVWSLGITCIELAERKPPLFNMNAMSALYHIAQNESPTLQSNEWSDYFRNFVDSCLQKIPQDRPTSEELLKHIFVLRERPETVLIDLIQRTKDAVRELDNLQYRKMKKLLFQEAHNGPAVEAQEEEEEQDHGVGRTGTVNSVGSNQSIPSMSISASSQSSSVNSLPDVSDDKSELDMMEGDHTVMSNSSVIHLKPEEENYREEGDPRTRASDPQSPPQVSRHKSHYRNREHFATIRTASLVTRQMQEHEQDSELREQMSGYKRMRRQHQKQLMTLENKLKAEMDEHRLRLDKDLETQRNNFAAEMEKLIKKHQAAMEKEAKVMSNEEKKFQQHIQAQQKKELNSFLESQKREYKLRKEQLKESKELQIKKQFQDTCKIQTRQYKALRNHLLETTPKSEHKAVLKRLKEEQTRKLAILAEQYDHSINEMLSTQALRLDEAQEAECQVLKMQLQQELELLNAYQSKIKMQAEAQHDRELRELEQRVSLRRALLEQKIEEEMLALQNERTERIRSLLERQAREIEAFDSESMRLGFSNMVLSNLSPEAFSHSYPGASGWSHNPTGGPGPHWGHPMGGPPQAWGHPMQGGPQPWGHPSGPMQGVPRGSSMGVRNSPQALRRTASGGRTEQGMSRSTSVTSQISNGSHMSYT

SEQ ID NO: 66410 - protein, 1049 aa, Homo sapiens
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKSKELQIKKQFQETCKIQTRQYKALRAHLLETTPKAQHKSLLKRLKEEQTRKLAILAEQYDQSISEMLSSQALRLDETQEAEFQALRQQLQQELELLNAYQSKIKIRTESQHERELRELEQRVALRRALLEQRVEEELLALQTGRSERIRSLLERQAREIEAFDAESMRLGFSSMALGGIPAEAAAQGYPAPPPAPAWPSRPVPRSGAHWSHGPPPPGMPPPAWRQPSLLAPPGPPNWLGPPTQSGTPRGGALLLLRNSPQPLRRAASGGSGSENVGPPAAAVPGPLSRSTSVASHILNGSSHFYS

SEQ ID NO: 66411 - protein, 1235 aa, Homo sapiens
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKVRAGQRPPGLPLPIPGALGPPNTGTPIEQQPCSPGQEAVLDQRMLGEEEEAVGERRILGKEGATLEPKQQRILGEESGAPSPSPQKHGSLVDEEVWGLPEEIEELRVPSLVPQERSIVGQEEAGTWSLWGKEDESLLDEEFELGWVQGPALTPVPEEEEEEEEGAPIGTPRDPGDGCPSPDIPPEPPPTHLRPCPASQLPGLLSHGLLAGLSFAVGSSSGLLPLLLLLLLPLLAAQGGGGLQAALLALEVGLVGLGASYLLLCTALHLPSSLFLLLAQGTALGAVLGLSWRRGLMGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 66412 - protein, 755 aa, Homo sapiens
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKKKTNTNKISER

SEQ ID NO: 66413 - protein, 1122 aa, Homo sapiens
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKERSIVGQEEAGTWSLWGKEDESLLDEEFELGWVQGPALTPVPEEEEEEEEGAPIGTPRDPGDGCPSPDIPPEPPPTHLRPCPASQLPGLLSHGLLAGLSFAVGSSSGLLPLLLLLLLPLLAAQGGGGLQAALLALEVGLVGLGASYLLLCTALHLPSSLFLLLAQGTALGAVLGLSWRRGLMGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 66414 - protein, 466 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVEMGFHHVGQAALELLTSVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPRVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 66415 - protein, 448 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPRVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 66416 - protein, 504 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKVQCSTSLYLSLVTLSPHPISKPMEGGCWCGRQNLGLEFTLIWVKTWHYILTVGLFEHAT

SEQ ID NO: 66417 - protein, 448 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 66418 - protein, 466 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVEMGFHHVGQAALELLTSVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 66419 - protein, 504 aa, Homo sapiens [sequence omitted]

SEQ ID NO: 66420 - protein, 448 aa, Homo sapiens; identical to SEQ ID NO: 66415

SEQ ID NO: 66421 - protein, 504 aa, Homo sapiens [sequence omitted]

SEQ ID NO: 66422 - protein, 466 aa, Homo sapiens; identical to SEQ ID NO: 66414

SEQ ID NO: 66423 - protein, 448 aa, Homo sapiens; identical to SEQ ID NO: 66415

SEQ ID NO: 66424 - protein, 504 aa, Homo sapiens; identical to SEQ ID NO: 66416

SEQ ID NO: 66425 - protein, 202 aa, Homo sapiens
MKSLSLLLAVALGLATAVSAGPAVIECWFVEDASGKGLAKRPGALLLRQGPGEPPPRPDLDPELYLSVHVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPRVQPFQEGTYLATIHLPYLQGQVTLELAVY

SEQ ID NO: 66426 - protein, 448 aa, Homo sapiens; identical to SEQ ID NO: 66417

SEQ ID NO: 66427 - protein, 466 aa, Homo sapiens; identical to SEQ ID NO: 66414

SEQ ID NO: 66428 - protein, 202 aa, Homo sapiens
MKSLSLLLAVALGLATAVSAGPAVIECWFVEDASGKGLAKRPGALLLRQGPGEPPPRPDLDPELYLSVHVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVY

SEQ ID NO: 66429 - protein, 202 aa, Homo sapiens; identical to SEQ ID NO: 66425

SEQ ID NO: 66430 - protein, 202 aa, Homo sapiens; identical to SEQ ID NO: 66425

SEQ ID NO: 66431 - protein, 448 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKHAT

SEQ ID NO: 66432 - protein, 504 aa, Homo sapiens [sequence omitted]

SEQ ID NO: 66433 - protein, 156 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSMGHAMPVEFTIPACLPRGAALRSPWR

SEQ ID NO: 66434 - protein, 466 aa, Homo sapiens; identical to SEQ ID NO: 66418

SEQ ID NO: 66435 - protein, 361 aa, Homo sapiens
MKSLSLLLAVALGLATAVSAGPAVIECWFVEDASGKGLAKRPGALLLRQGPGEPPPRPDLDPELYLSVHVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 66436 - protein, 448 aa, Homo sapiens; identical to SEQ ID NO: 66431

SEQ ID NO: 66437 - protein, 156 aa, Homo sapiens; identical to SEQ ID NO: 66433

SEQ ID NO: 66438 - protein, 361 aa, Homo sapiens
MKSLSLLLAVALGLATAVSAGPAVIECWFVEDASGKGLAKRPGALLLRQGPGEPPPRPDLDPELYLSVHVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPRVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKHAT

SEQ ID NO: 66439 - protein, 448 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPRVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKHAT

SEQ ID NO: 66440 - protein, 361 aa, Homo sapiens; identical to SEQ ID NO: 66438

SEQ ID NO: 66441 - protein, 156 aa, Homo sapiens; identical to SEQ ID NO: 66433

SEQ ID NO: 66442 - protein, 448 aa, Homo sapiens; identical to SEQ ID NO: 66439

SEQ ID NO: 66443 - protein, 361 aa, Homo sapiens; identical to SEQ ID NO: 66435

SEQ ID NO: 66444 - protein, 448 aa, Homo sapiens; identical to SEQ ID NO: 66439

SEQ ID NO: 66445 - protein, 361 aa, Homo sapiens; identical to SEQ ID NO: 66438

SEQ ID NO: 66446 - protein, 678 aa, Homo sapiens
MLLEAERRRGGGAAGARLLERYRRVPGVRALRADSVLIIETVPGFPPAPPAPGAAQIRAAEVLVYGAPPGRVSRLLERFDPPAAPRRRGSPERARPPPPPPPPAPPRPPPAAPSPPAAPGPRGGGASPGARRSDFLQKTGSNSFTVHPRGLHRGAGARLLSNGHSAPEPRAGPANRLAGSPPGSGQWKPKVESGDPSLHPPPSPGTPSATPASPPASATPSQRQCVSAATSTNDSFEIRPAPKPVMETIPLGDLQARALASLRANSRNSFMVIPKSKASGAPPPEGRQSVELPKGDLGPASPSQELGSQPVPGGDGAPALGKSPLEVEAQWAVEEGACPRTATALADRAIRWQRPSSPPPFLPAASEEAEPAEGLRVPGLAKNSREYVRPGLPVTFIDEVDSEEAPQAAKLPYLPHPARPLHPARPGCVAELQPRGSNTFTVVPKRKPGTLQDQHFSQANREPRPREAEEEEASCLLGPTLKKRYPTVHEIEVIGGYLALQKSCLTKAGSSRKKMKISFNDKSLQTTFEYPSESSLEQEEEVDQQEEEEEEEEEEEEEEEGSGSEEKPFALFLPRATFVSSVRPESSRLPEGSSGLSSYTPKHSVAFSKWQEQALEQAPREAEPPPVEAMVRCGGVERWGESDTRASPCVHILSSHFQLTPASQNDLSDFRSEPALYF

SEQ ID NO: 66447 - protein, 711 aa, Homo sapiens
MAALGRPGSGPRAAVPAWKREILERKRAKLAALGGGAGPGAAEPEQRVLAESLGPLRENPFMLLEAERRRGGGAAGARLLERYRRVPGVRALRADSVLIIETVPGFPPAPPAPGAAQIRAAEVLVYGAPPGRVSRLLERFDPPAAPRRRGSPERARPPPPPPPPAPPRPPPAAPSPPAAPGPRGGGASPGARRSDFLQKTGSNSFTVHPRGLHRGAGARLLSNGHSAPEPRAGPANRLAGSPPGSGQWKPKVESGDPSLHPPPSPGTPSATPASPPASATPSQRQCVSAATSTNDSFEIRPAPKPVMETIPLGDLQARALASLRANSRNSFMVIPKSKASGAPPPEGRQSVELPKGDLGPASPSQELGSQPVPGGDGAPALGKSPLEVEAQWAVEEGACPRTATALADRAIRWQRPSSPPPFLPAASEEAEPAEGLRVPGLAKNSREYVRPGLPVTFIDEVDSEEAPQAAKLPYLPHPARPLHPARPGCVAELQPRGSNTFTVVPKRKPGTLQDQHFSQANREPRPREAEEEEASCLLGPTLKKRYPTVHEIEVIGGYLALQKSCLTKAGSSRKKMKISFNDKSLQTTFEYPSESSLEQEEEVDQQEEEEEEEEEEEEEEEGSGSEEKPFALFLPRATFVSSVRPESSRLPEGSSGLSSYTPKHSVAFSKWQEQALEQAPREAEPPPVEAMLTPASQNDLSDFRSEPALYF

SEQ ID NO: 66448 - protein, 1621 aa, Homo sapiens
MEWVLAEALLSQSRDPRALLGALCQGEASAERVETLRFLLQRLEDEEARGSGGAGALPEAAREVAAGYLVPLLRSLRGRPAGGPDPSLQPRHRRRVLRAAGAALRSCVRLAGRPQLAAALAEEALRDLLAGWRAPGAEAAVEVLAAVGPCLRPREDGPLLERVAGTAVALALGGGGDGDEAGPAEDAAALVAGRLLPVLVQCGGAALRAVWGGLAAPGASLGSGRVEEKLLVLSALAEKLLPEPGGDRARGAREAGPDARRCWRFWRTVQAGLGQADALTRKRARYLLQRAVEVSAELGADCTCGPQEGNGPSLFWWSERKKDELLKFWENYILIMETLEGNQIHVIKPVLPKLNNLFEYAVSEENGCWLFHPSWHMCIYKRMFESENKILSKEGVIHFLELYETKILPFSPEFSEFIIGPLMDALSESSLYSRSPGQPIGSCSPLGLKLQKFLVTYISLLPEEIKSSFLLKFIRKMTSRHWCAVPILFLSKALANVPRHKALGIDGLLALRDVIHCTMITHQILLRGAAQCYLLQTAMNLLDVEKVSLSDVSTFLMSLRQEESLGRGTSLWTELCDWLRVNESYFKPSPTCSSIGLHKTSLNAYVKSIVQEYVKSSAWETGENCFMPDWFEAKLVSLMVLLAVDVEGMKTQYSGKQRTENVLRIFLDPLLDVLMKFSTNAYMPLLKTDRCLQLLLKLLNTCRLKGSSAQDDEVSTVLQNFFMSTTESISEFILRRLTMNELNSVSDLDRCHLYLMVLTELINLHLKVGWKRGNPIWRVISLLKNASIQHLQEMDSGQEPTVGSQIQRVVSMAALAMVCEAIDQKPELQLDSLHAGPLESFLSSLQLNQTLQKPHAEEQSSYAHPLECSSVLEESSSSQGWGKIVAQYIHDQWVCLSFLLKKYHTLIPTTGSEILEPFLPAVQMPIRTLQSALEALTVLSSDQVLPVFHCLKVLVPKLLTSSESLCIESFDMAWKIISSLSNTQLIFWANLKAFVQFVFDNKVLTIAAKIKGQAYFKIKEIMYKIIEMSAIKTGVFNTLISYCCQSWIVSASNVSQGSLSSAKNYSELILEACIFGTVFRRDQRLVQDVQTFIENLGHDCAANIVMENTKREDHYVRICAVKFLCLLDGSNMSHKLFIEDLAIKLLDKDELVSKSKKRYYVNSLQHRVKNRVWQTLLVLFPRLDQNFLNGIIDRIFQAGFTNNQASIKYFIEWIIILILHKFPQFLPKFWDCFSYGEENLKTSICTFLAVLSHLDIITQNIPEKKLILKQALIVVLQWCFNHNFSVRLYALVALKKLWTVCKVLSVEEFDALTPVIESSLHQVESMHGAGNAKKNWQRIQEHFFFATFHPLKDYCLETIFYILPRLSGLIEDEWITIDKFTRFTDVPLAAGFQWYLSQTQLSKLKPGDWSQQDIGTNLVEADNQAEWTDVQKKIIPWNSRVSDLDLELLFQDRAARLGKSISRLIVVASLIDKPTNLGGLCRTCEVFGASVLVVGSLQCISDKQFQHLSVSAEQWLPLVEVKPPQLIDYLQQKKTEGYTIIGVEQTAKSLDLTQYCFPEKSLLLLGNEREGIPANLIQQLDVCVEIPQQGIIRSLNVHVSGALLIWEYTRQQLLSHGDTKP

SEQ ID NO: 66449 - protein, 366 aa, Homo sapiens
MSEEEQGSGTTTGCGLPSIEQMLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 66450 - protein, 345 aa, Homo sapiens
MLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 66451 - protein, 345 aa, Homo sapiens; identical to SEQ ID NO: 66450

SEQ ID NO: 66452 - protein, 414 aa, Homo sapiens
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPGGFGNQGGFGNSRGGGAGLGNNQGSNMGGGMNFGAFSINPAMMAAAQAALQSSWGMMGMLASQQNQSGPSGNNQNQGNMQREPNQAFGSGNNSYSGSNSGAAIGWGSASNAGSGSGFNGGFGSSMDSKSSGWGM

SEQ ID NO: 66453 - protein, 295 aa, Homo sapiens
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGVHLISNVYGRSTSLKVVL

SEQ ID NO: 66454 - protein, 298 aa, Homo sapiens
MPQMLAGEIWCMLSTIQKVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPGGFGNQGGFGNSRGGGAGLGNNQGSNMGGGMNFGAFSINPAMMAAAQAALQSSWGMMGMLASQQNQSGPSGNNQNQGNMQREPNQAFGSGNNSYSGSNSGAAIGWGSASNAGSGSGFNGGFGSSMDSKSSGWGM

SEQ ID NO: 66455 - protein, 510 aa, Homo sapiens
MAADSDDGAVSAPAASDGGVSKSTTSGEELVVQVPVVDVQSNNFKEMWPSLLLAIKTANFVAVDTELSGLGDRKSLLNQCIEERYKAVCHAARTRSILSLGLACFKRQPDKGEHSYLAQVFNLTLLCMEEYVIEPKSVQFLIQHGFNFNQQYAQGIPYHKGNDKGDESQSQSVRTLFLELIRARRPLVLHNGLIDLVFLYQNFYAHLPESLGTFTADLCEMFPAGIYDTKYAAEFHARFVASYLEYAFRKCERENGKQRAAGSPHLTLEFCNYPSSMRDHIDYRCCLPPATHRPHPTSICDNFSAYGWCPLGPQCPQSHDIDLIIDTDEAAAEDKRRRRRRREKRKRALLNLPGTQTSGEAKDGPPKKQVCGDSIKPEETEQEVAADETRNLPHSKQGNKNDLEMGIKAARPEIADRATSEVPGSQASPNPVPGDGLHRAGFDAFMTGYVMAYVEVSQGPQPCSSGPWLPECHNKVYLSGKAVPLTVAKSQFSRSSKAHNQKMKLTWGSS

SEQ ID NO: 66456 - protein, 430 aa, Homo sapiens
MAADSDDGAVSAPAASDGAEWAWGQEEFAEPGEHSYLAQVFNLTLLCMEEYVIEPKSVQFLIQHGFNFNQQYAQGIPYHKGNDKGDESQSQSVRTLFLELIRARRPLVLHNGLIDLVFLYQNFYAHLPESLGTFTADLCEMFPAGIYDTKYAAEFHARFVASYLEYAFRKCERENGKQRAAGSPHLTLEFCNYPSSMRDHIDYRCCLPPATHRPHPTSICDNFSAYGWCPLGPQCPQSHDIDLIIDTDEAAAEDKRRRRRRREKRKRALLNLPGTQTSGEAKDGPPKKQVCGDSIKPEETEQEVAADETRNLPHSKQGNKNDLEMGIKAARPEIADRATSEVPGSQASPNPVPGDGLHRAGFDAFMTGYVMAYVEVSQGPQPCSSGPWLPECHNKVYLSGKAVPLTVAKSQFSRSSKAHNQKMKLTWGSS

SEQ ID NO: 66457 - protein, 420 aa, Homo sapiens
MTMEKGMSSGEGLPSRSSQVSAGKITAKELETKQSYKEKRGGFVLVHAGAGYHSESKAKEYKHVCKRACQKAIEKLQAGALATDAVTAALVELEDSPFTNAGMGSNLNLLGEIECDASIMDGKSLNFGAVGALSGIKNPVSVANRLLCEGQKGKLSAGRIPPCFLVGEGAYRWAVDHGIPSCPPNIMTTRFSLAAFKRNKRKLELAERVDTDFMQLKKRRQSSEKENDSGTLDTVGAVVVDHEGNVAAAVSSGGLALKHPGRVGQAALYGCGCWAENTGAHNPYSTAVSTSGCGEHLVRTILARECSHALQAEDAHQALLETMQNKFISSPFLASEDGVLGGVIVLRSCRCSAEPDSSQNKQTLLVEFLWSHTTESMCVGYMSAQDGKAKTHISRLPPGAVAGQSVAIEGGVCRLESPVN

SEQ ID NO: 66458 - protein, 305 aa, Homo sapiens
MTMEKGMSSGEGLPSRSSQVSAGKITAKELETKQSYKEKRGGFVLVHAGAGYHSESKAKEYKHVCKRACQKDSPFTNAGMGSNLNLLGEIECDASIMDGKSLNFGAVGALSGIKNPVSVANRLLCEGQKGKLSAGRIPPCFLVGEGAYRWAVDHGIPSCPPNIMTTRFSLAAFKRNKRKLELAERVDTDFMQLKKRRQSSEKENDSGTLDTVGAVVVDHEGNVAAAVSSGGLALKHPGRVGQAALYGCGCWAENTGAHNPYSTAVSTSGCGEHLVRTILARECSHALQAEDAHQALLETMQNKFI

SEQ ID NO: 66459 - protein, 110 aa, Homo sapiens
  MOD_RES (1)..(1): Any amino acid
XKITAKELETKQSYKEKRGGFVLVHAGAGYHSESKAKEYKHVCKRACQKAIEKLQAGALATDAVTAALVELELMWKGQFQVLCVLTNLFLDIIKNPTKTKFKTISNVKVY

SEQ ID NO: 66460 - protein, 305 aa, Homo sapiens; identical to SEQ ID NO: 66458

SEQ ID NO: 66461 - protein, 145 aa, Homo sapiens
MTMEKGMSSGEGLPSRSSQVSAGKITAKELETKQSYKEKRGGFVLVHAGAGYHSESKAKEYKHVCKRACQKAIEKLQAGALATDAVTAALVELEDVESILCAPYWLENVHMLYKLRMLTKPCWRLCKTSLSVHLSLPVKMACLAE

SEQ ID NO: 66462 - protein, 129 aa, Homo sapiens
MTMEKGMSSGEGLPSRSSQVSAGKITAKELETKQSYKEKRGGFVLVHAGAGYHSESKAKEYKHVCKRACQKAIEKLQAGALATDAVTAALVELEVYTHSYTSWSCIQPSIHVLLVKRQRKSPLPRISTF

SEQ ID NO: 66463 - protein, 480 aa, Homo sapiens
MLLCTARLVGLQLLISCCWAFACHSTESSPDFTLPGDYLLAGLFPLHSGCLQVRHRPEVTLCDRSCSFNEHGYHLFQAMRLGVEEINNSTALLPNITLGYQLYDVCSDSANVYATLRVLSLPGQHHIELQGDLLHYSPTVLAVIGPDSTNRAATTAALLSPFLVPMISYAASSETLSVKRQYPSFLRTIPNDKYQVETMVLLLQKFGWTWISLVGSSDDYGQLGVQALENQATGQGICIAFKDIMPFSAQVGDERMQCLMRHLAQAGATVVVVFSSRQLARVFFESVVLTNLTGKVWVASEAWALSRHITGVPGIQRIGMVLGVAIQKRAVPGLKAFEEAYARADKKAPRPCHKGSWCSSNQLCRECQAFMAHTMPKLKAFSMSSAYNAYRAVYAVAHGLHQLLGCASGACSRGRVYPWQTSTDASLVGKKSGHLREARPASRALWCFWLCVSTPLGCCWQLTRCCCCCCLGLLACLPGT

SEQ ID NO: 66464 - protein, 841 aa, Homo sapiens
MLLCTARLVGLQLLISCCWAFACHSTESSPDFTLPGDYLLAGLFPLHSGCLQVRHRPEVTLCDRSCSFNEHGYHLFQAMRLGVEEINNSTALLPNITLGYQLYDVCSDSANVYATLRVLSLPGQHHIELQGDLLHYSPTVLAVIGPDSTNRAATTAALLSPFLVPMISYAASSETLSVKRQYPSFLRTIPNDKYQVETMVLLLQKFGWTWISLVGSSDDYGQLGVQALENQATGQGICIAFKDIMPFSAQVGDERMQCLMRHLAQAGATVVVVFSSRQLARVFFESVVLTNLTGKVWVASEAWALSRHITGVPGIQRIGMVLGVAIQKRAVPGLKAFEEAYARADKKAPRPCHKGSWCSSNQLCRECQAFMAHTMPKLKAFSMSSAYNAYRAVYAVAHGLHQLLGCASGACSRGRVYPWQLLEQIHKVHFLLHKDTVAFNDNRDPLSSYNIIAWDWNGPKWTFTVLGSSTWSPVQLNINETKIQWHGKDNQVPKSVCSSDCLEGHQRVVTGFHHCCFECVPCGAGTFLNKSDLYRCQPCGKEEWAPEGSQTCFPRTVVFLALREHTSWVLLAANTLLLLLLLGTAGLFAWHLDTPVVRSAGGRLCFLMLGSLAAGSGSLYGFFGEPTRPACLLRQALFALGFTIFLSCLTVRSFQLIIIFKFSTKVPTFYHAWVQNHGAGLFVMISSAAQLLICLTWLVVWTPLPAREYQRFPHLVMLECTETNSLGFILAFLYNGLLSISAFACSYLGKDLPENYNEAKCVTFSLLFNFVSWIAFFTTASVYDGKYLPAANMMAGLSSLSSGFGGYFLPKCYVILCRPDLNSTEHFQASIQDYTRRCGST

SEQ ID NO: 66465 - protein, 587 aa, Homo sapiens
MLLCTARLVGLQLLISCCWAFACHSTESSPDFTLPGDYLLAGLFPLHSGCLQVRHRPEVTLCDRSCSFNEHGYHLFQAMRLGVEEINNSTALLPNITLGYQLYDVCSDSANVYATLRVLSLPGQHHIELQGDLLHYSPTVLAVIGPDSTNRAATTAALLSPFLVPMLLEQIHKVHFLLHKDTVAFNDNRDPLSSYNIIAWDWNGPKWTFTVLGSSTWSPVQLNINETKIQWHGKDNQVPKSVCSSDCLEGHQRVVTGFHHCCFECVPCGAGTFLNKSDLYRCQPCGKEEWAPEGSQTCFPRTVVFLALREHTSWVLLAANTLLLLLLLGTAGLFAWHLDTPVVRSAGGRLCFLMLGSLAAGSGSLYGFFGEPTRPACLLRQALFALGFTIFLSCLTVRSFQLIIIFKFSTKVPTFYHAWVQNHGAGLFVMISSAAQLLICLTWLVVWTPLPAREYQRFPHLVMLECTETNSLGFILAFLYNGLLSISAFACSYLGKDLPENYNEAKCVTFSLLFNFVSWIAFFTTASVYDGKYLPAANMMAGLSSLSSGFGGYFLPKCYVILCRPDLNSTEHFQASIQDYTRRCGST

SEQ ID NO: 66466 - protein, 306 aa, Homo sapiens
MRLGVEEINNSTALLPNITLGYQLYDVCSDSANVYATLRVLSLPGQHHIELQGDLLHYSPTVLAVIGPDSTNRAATTAALLSPFLVPMLLEQIHKVHFLLHKDTVAFNDNRDPLSSYNIIAWDWNGPKWTFTVLGSSTWSPVQLNINETKIQWHGKDNQVPKSVCSSDCLEGHQRVVTGFHHCCFECVPCGAGTFLNKSDLYRCQPCGKEEWAPEGSQTCFPRTVVFLALREHTSWVLLAANTLLLLLLLGTAGLFAWHLDTPVVRSAGGRLCFLMLGSLAAGSGSLYGFFGEPSLPLVSPSSCPA

SEQ ID NO: 66467 - protein, 839 aa, Homo sapiens
MGPRAKTISSLFFLLWVLAEPAENSDFYLPGDYLLGGLFSLHANMKGIVHLNFLQVPMCKEYEVKVIGYNLMQAMRFAVEEINNDSSLLPGVLLGYEIVDVCYISNNVQPVLYFLAHEDNLLPIQEDYSNYISRVVAVIGPDNSESVMTVANFLSLFLLPQITYSAISDELRDKVRFPALLRTTPSADHHIEAMVQLMLHFRWNWIIVLVSSDTYGRDNGQLLGERVARRDICIAFQETLPTLQPNQNMTSEERQRLVTIVDKLQQSTARVVVVFSPDLTLYHFFNEVLRQNFTGAVWIASESWAIDPVLHNLTELRHLGTFLGITIQSVPIPGFSEFREWGPQAGPPPLSRTSQSYTCNQECDNCLNATLSFNTILRLSGERVVYSVYSAVYAVAHALHSLLGCDKSTCTKRVVYPWQLLEEIWKVNFTLLDHQIFFDPQGDVALHLEIVQWQWDRSQNPFQSVASYYPLQRQLKNIQDISWHTINNTIPMSMCSKRCQSGQKKKPVGIHVCCFECIDCLPGTFLNHTEDEYECQACPNNEWSYQSETSCFKRQLVFLEWHEAPTIAVALLAALGFLSTLAILVIFWRHFQTPIVRSAGGPMCFLMLTLLLVAYMVVPVYVGPPKVSTCLCRQALFPLCFTICISCIAVRSFQIVCAFKMASRFPRAYSYWVRYQGPYVSMAFITVLKMVIVVIGMLATGLSPTTRTDPDDPKITIVSCNPNYRNSLLFNTSLDLLLSVVGFSFAYMGKELPTNYNEAKFITLSMTFYFTSSVSLCTFMSAYSGVLVTIVDLLVTVLNLLAISLGYFGPKCYMILFYPERNTPAYFNSMIQGYTMRRD

SEQ ID NO: 66468 - protein, 852 aa, Homo sapiens
MLGPAVLGLSLWALLHPGTGAPLCLSQQLRMKGDYVLGGLFPLGEAEEAGLRSRTRPSSPVCTRFSSNGLLWALAMKMAVEEINNKSDLLPGLRLGYDLFDTCSEPVVAMKPSLMFLAKAGSRDIAAYCNYTQYQPRVLAVIGPHSSELAMVTGKFFSFFLMPQVSYGASMELLSARETFPSFFRTVPSDRVQLTAAAELLQEFGWNWVAALGSDDEYGRQGLSIFSALAAARGICIAHEGLVPLPRADDSRLGKVQDVLHQVNQSSVQVVLLFASVHAAHALFNYSISSRLSPKVWVASEAWLTSDLVMGLPGMAQMGTVLGFLQRGAQLHEFPQYVKTHLALATDPAFCSALGEREQGLEEDVVGQRCPQCDCITLQNVSAGLNHHQTFSVYAAVYSVAQALHNTLQCNASGCPAQDPVKPWQLLENMYNLTFHVGGLPLRFDSSGNVDMEYDLKLWVWQGSVPRLHDVGRFNGSLRTERLKIRWHTSDNQKPVSRCSRQCQEGQVRRVKGFHSCCYDCVDCEAGSYRQNPDDIACTFCGQDEWSPERSTRCFRRRSRFLAWGEPAVLLLLLLLSLALGLVLAALGLFVHHRDSPLVQASGGPLACFGLVCLGLVCLSVLLFPGQPSPARCLAQQPLSHLPLTGCLSTLFLQAAEIFVESELPLSWADRLSGCLRGPWAWLVVLLAMLVEVALCTWYLVAFPPEVVTDWHMLPTEALVHCRTRSWVSFGLAHATNATLAFLCFLGTFLVRSQPGCYNRARGLTFAMLAYFITWVSFVPLLANVQVVLRPAVQMGALLLCVLGILAAFHLPRCYLLMRQPGLNTPEFFLGGGPGDAQGQNDGNTGNQGKHE

SEQ ID NO: 66469 - protein, 291 aa, Homo sapiens
MIPIQLTVFFMIIYVLESLTIIVQSSLIVAVLGREWLQVRRLMPVDMILISLGISRFCLQWASMLNNFCSYFNLNYVLCNLTITWEFFNILTFWLNSLLTVFYCIKVSSFTHHIFLWLRWRILRLFPWILLGSLMITCVTIIPSAIGNYIQIQLLTMEHLPRNSTVTDKLENFHQYQFQAHTVALVIPFILFLASTIFLMASLTKQIQHHSTGHCNPSMKARFTALRSLAVLFIVFTSYFLTILITIIGTLFDKRCWLWVWEAFVYAFILMHSTSLMLSSPTLKRILKGKC

SEQ ID NO: 66470 - protein, 299 aa, Homo sapiens
MMCFLLIISSILVVFAFVLGNVANGFIALVNVIDWVNTRKISSAEQILTALVVSRIGLLWVMLFLWYATVFNSALYGLEVRIVASNAWAVTNHFSMWLAASLSIFCLLKIANFSNLISLHLKKRIKSVVLVILLGPLVFLICNLAVITMDERVWTKEYEGNVTWKIKLRNAIHLSSLTVTTLANLIPFTLSLICFLLLICSLCKHLKKMRLHSKGSQDPSTKVHIKALQTVTSFLMLFAIYFLCIITSTWNLRTQQSKLVLLLCQTVAIMYPSFHSFILIMGSRKLKQTFLSVLWQMTR

SEQ ID NO: 66471 - protein, 309 aa, Homo sapiens
MMSFLHIVFSILVVVAFILGNFANGFIALINFIAWVKRQKISSADQIIAALAVSRVGLLWVILLHWYSTVLNPTSSNLKVIIFISNAWAVTNHFSIWLATSLSIFYLLKIVNFSRLIFHHLKRKAKSVVLVIVLGSLFFLVCHLVMKHTYINVWTEECEGNVTWKIKLRNAMHLSNLTVAMLANLIPFTLTLISFLLLIYSLCKHLKKMQLHGKGSQDPSTKIHIKALQTVTSFLILLAIYFLCLIISFWNFKMRPKEIVLMLCQAFGIIYPSFHSFILIWGNKTLKQTFLSVLWQVTCWAKGQNQSTP

SEQ ID NO: 66472 - protein, 316 aa, Homo sapiens
MMGLTEGVFLILSGTQFTLGILVNCFIELVNGSSWFKTKRMSLSDFIITTLALLRIILLCIILTDSFLIEFSPNTHDSGIIMQIIDVSWTFTNHLSIWLATCLGVLYCLKIASFSHPTFLWLKWRVSRVMVWMLLGALLLSCGSTASLINEFKLYSVFRGIEATRNVTEHFRKKRSEYYLIHVLGTLWYLPPLIVSLASYSLLIFSLGRHTRQMLQNGTSSRDPTTEAHKRAIRIILSFFFLFLLYFLAFLIASFGNFLPKTKMAKMIGEVMTMFYPAGHSFILILGNSKLKQTFVVMLRCESGHLKPGSKGPIFS

SEQ ID NO: 66473 - protein, 319 aa, Homo sapiens
MITFLPIIFSILIVVIFVIGNFANGFIALVNSIEWVKRQKISFVDQILTALAVSRVGLLWVLLLHWYATQLNPAFYSVEVRITAYNVWAVTNHFSSWLATSLSMFYLLRIANFSNLIFLRIKRRVKSVVLVILLGPLLFLVCHLFVINMDETVWTKEYEGNVTWKIKLRSAMYHSNMTLTMLANFVPLTLTLISFLLLICSLCKHLKKMQLHGKGSQDPSTKVHIKALQTVTSFLLLCAIYFLSMIISVCNFGRLEKQPVFMFCQAIIFSYPSTHPFILILGNKKLKQIFLSVLRHVRYWVKDRSLRLHRFTRGALCVF

SEQ ID NO: 66474 - protein, 309 aa, Homo sapiens
MTTFIPIIFSSVVVVLFVIGNFANGFIALVNSIERVKRQKISFADQILTALAVSRVGLLWVLLLNWYSTVFNPAFYSVEVRTTAYNVWAVTGHFSNWLATSLSIFYLLKIANFSNLIFLHLKRRVKSVILVMLLGPLLFLACQLFVINMKEIVRTKEYEGNLTWKIKLRSAVYLSDATVTTLGNLVPFTLTLLCFLLLICSLCKHLKKMQLHGKGSQDPSTKVHIKALQTVIFFLLLCAVYFLSIMISVWSFGSLENKPVFMFCKAIRFSYPSIHPFILIWGNKKLKQTFLSVLRQVRYWVKGEKPSSP

SEQ ID NO: 66475 - protein, 333 aa, Homo sapiens
MLTLTRIRTVSYEVRSTFLFISVLEFAVGFLTNAFVFLVNFWDVVKRQALSNSDCVLLCLSISRLFLHGLLFLSAIQLTHFQKLSEPLNHSYQAIIMLWMIANQANLWLAACLSLLYCSKLIRFSHTFLICLASWVSRKISQMLLGIILCSCICTVLCVWCFFSRPHFTVTTVLFMNNNTRLNWQIKDLNLFYSFLFCYLWSVPPFLLFLVSSGMLTVSLGRHMRTMKVYTRNSRDPSLEAHIKALKSLVSFFCFFVISSCAAFISVPLLILWRDKIGVMVCVGIMAACPSGHAAILISGNAKLRRAVMTILLWAQSSLKVRADHKADSRTLC

SEQ ID NO: 66476 - protein, 299 aa, Homo sapiens
MLRLFYFSAIIASVILNFVGIIMNLFITVVNCKTWVKSHRISSSDRILFSLGITRFLMLGLFLVNTIYFVSSNTERSVYLSAFFVLCFMFLDSSSVWFVTLLNILYCVKITNFQHSVFLLLKRNISPKIPRLLLACVLISAFTTCLYITLSQASPFPELVTTRNNTSFNISEGILSLVVSLVLSSSLQFIINVTSASLLIHSLRRHIQKMQKNATGFWNPQTEAHVGAMKLMVYFLILYIPYSVATLVQYLPFYAGMDMGTKSICLIFATLYSPGHSVLIIITHPKLKTTAKKILCFKK

SEQ ID NO: 66477 - protein, 323 aa, Homo sapiens
MATVNTDATDKDISKFKVTFTLVVSGIECITGILGSGFITAIYGAEWARGKTLPTGDRIMLMLSFSRLLLQIWMMLENIFSLLFRIVYNQNSVYILFKVITVFLNHSNLWFAAWLKVFYCLRIANFNHPLFFLMKRKIIVLMPWLLRLSVLVSLSFSFPLSRDVFNVYVNSSIPIPSSNSTEKKYFSETNMVNLVFFYNMGIFVPLIMFILAATLLILSLKRHTLHMGSNATGSRDPSMKAHIGAIKATSYFLILYIFNAIALFLSTSNIFDTYSSWNILCKIIMAAYPAGHSVQLILGNPGLRRAWKRFQHQVPLYLKGQTL

SEQ ID NO: 66478 - protein, 307 aa, Homo sapiens
MQAALTAFFVLLFSLLSLLGIAANGFIVLVLGREWLRYGRLLPLDMILISLGASRFCLQLVGTVHNFYYSAQKVEYSGGLGRQFFHLHWHFLNSATFWFCSWLSVLFCVKIANITHSTFLWLKWRFPGWVPWLLLGSVLISFIITLLFFWVNYPVYQEFLIRKFSGNMTYKWNTRIETYYFPSLKLVIWSIPFSVFLVSIMLLINSLRRHTQRMQHNGHSLQDPSTQAHTRALKSLISFLILYALSFLSLIIDAAKFISMQNDFYWPWQIAVYLCISVHPFILIFSNLKLRSVFSQLLLLARGFWVA

SEQ ID NO: 66479 - protein, 314 aa, Homo sapiens
MATELDKIFLILAIAEFIISMLGNVFIGLVNCSEGIKNQKVFSADFILTCLAISTIGQLLVILFDSFLVGLASHLYTTYRLGKTVIMLWHMTNHLTTWLATCLSIFYFFKIAHFPHSLFLWLRWRMNGMIVMLLILSLFLLIFDSLVLEIFIDISLNIIDKSNLTLYLDESKTLYDKLSILKTLLSLTSFIPFSLFLTSLLFLFLSLVRHTRNLKLSSLGSRDSSTEAHRRAMKMVMSFLFLFIVHFFSLQVANGIFFMLWNNKYIKFVMLALNAFPSCHSFILILGNSKLRQTAVRLLWHLRNYTKTPNALPL

SEQ ID NO: 66480 - protein, 309 aa, Homo sapiens
MITFLPIIFSSLVVVTFVIGNFANGFIALVNSIEWFKRQKISFADQILTALAVSRVGLLWVLLLNWYSTVLNPAFNSVEVRTTAYNIWAVINHFSNWLATTLSIFYLLKIANFSNFIFLHLKRRVKSVILVMLLGPLLFLACHLFVINMNEIVRTKEFEGNMTWKIKLKSAMYFSNMTVTMVANLVPFTLTLLSFMLLICSLCKHLKKMQLHGKGSQDPSTKVHIKALQTVISFLLLCAIYFLSIMISVWSFGSLENKPVFMFCKAIRFSYPSIHPFILIWGNKKLKQTFLSVFWQMRYWVKGEKTSSP

SEQ ID NO: 66481 - protein, 309 aa, Homo sapiens
MITFLPIIFSILIVVTFVIGNFANGFIALVNSIEWFKRQKISFADQILTALAVSRVGLLWVLVLNWYATELNPAFNSIEVRITAYNVWAVINHFSNWLATSLSIFYLLKIANFSNLIFLHLKRRVKSVVLVILLGPLLFLVCHLFVINMNQIIWTKEYEGNMTWKIKLRSAMYLSNTTVTILANLVPFTLTLISFLLLICSLCKHLKKMQLHGKGSQDPSMKVHIKALQTVTSFLLLCAIYFLSIIMSVWSFESLENKPVFMFCEAIAFSYPSTHPFILIWGNKKLKQTFLSVLWHVRYWVKGEKPSSS

SEQ ID NO: 66482 - protein, 299 aa, Homo sapiens
MLSAGLGLLMLVAVVEFLIGLIGNGSLVVWSFREWIRKFNWSSYNLIILGLAGCRFLLQWLIILDLSLFPLFQSSRWLRYLSIFWVLVSQASLWFATFLSVFYCKKITTFDRPAYLWLKQRAYNLSLWCLLGYFIINLLLTVQIGLTFYHPPQGNSSIRYPFESWQYLYAFQLNSGSYLPLVVFLVSSGMLIVSLYTHHKKMKVHSAGRRDVRAKAHITALKSLGCFLLLHLVYIMASPFSITSKTYPPDLTSVFIWETLMAAYPSLHSLILIMGIPRVKQTCQKILWKTVCARRCWGP

SEQ ID NO: 66483 - protein, 299 aa, Homo sapiens
MITFLYIFFSILIMVLFVLGNFANGFIALVNFIDWVKRKKISSADQILTALAVSRIGLLWALLLNWYLTVLNPAFYSVELRITSYNAWVVTNHFSMWLAANLSIFYLLKIANFSNLLFLHLKRRVRSVILVILLGTLIFLVCHLLVANMDESMWAEEYEGNMTGKMKLRNTVHLSYLTVTTLWSFIPFTLSLISFLMLICSLCKHLKKMQLHGEGSQDLSTKVHIKALQTLISFLLLCAIFFLFLIVSVWSPRRLRNDPVVMVSKAVGNIYLAFDSFILIWRTKKLKHTFLLILCQIRC

SEQ ID NO: 66484 - protein, 318 aa, Homo sapiens
MNGDHMVLGSSVTDKKAIILVTILLLLRLVAIAGNGFITAALGVEWVLRRMLLPCDKLLVSLGASRFCLQSVVMGKTIYVFLHPMAFPYNPVLQFLAFQWDFLNAATLWSSTWLSVFYCVKIATFTHPVFFWLKHKLSGWLPWMLFSSVGLSSFTTILFFIGNHRMYQNYLRNHLQPWNVTGDSIRSYCEKFYLFPLKMITWTMPTAVFFICMILLITSLGRHRKKALLTTSGFREPSVQAHIKALLALLSFAMLFISYFLSLVFSAAGIFPPLDFKFWVWESVIYLCAAVHPIILLFSNCRLRAVLKSRRSSRCGTP

SEQ ID NO: 66485 - protein, 339 aa, Homo sapiens
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSSYEPELFPGLIYRMIKPRIVLLIFVSGKVVLTGAKVRAEIYEAFENIYPILKGFRKTT

SEQ ID NO: 66486 - protein, 316 aa, Homo sapiens
MDQNNSLPPYAQGLASPQGAMTPGIPIFSPMMPYGTGLTPQPIQNTNSLSILEEQQRQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSSYEPELFPGLIYRMIKPRIVLLIFVSGKVVLTGAKVRAEIYEAFENIYPILKGFRKTT

SEQ ID NO: 66487 - protein, 339 aa, Homo sapiens; identical to SEQ ID NO: 66485

SEQ ID NO: 66488 - protein, 208 aa, Homo sapiens
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPR

SEQ ID NO: 66489 - protein, 151 aa, Homo sapiens [sequence omitted]

SEQ ID NO: 66490 - protein, 101 aa, Homo sapiens
  MOD_RES (1)..(1): Any amino acid
XEEQSRLAARKYARVVQKLGFPAKFLDFKIQNMVGSCDVKFPISYEPELFPGLIYRMIKPRIVLLIFVSGKVVLTGAKVRAEIYEAFENIYPILKGFRKTT

SEQ ID NO: 66491 - protein, 319 aa, Homo sapiens
MTPGIPIFSPMMPYGTGLTPQPIQNTNSLSILEEQQRQQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSSYEPELFPGLIYRMIKPRIVLLIFVSGKVVLTGAKVRAEIYEAFENIYPILKGFRKTT

SEQ ID NO: 66492 - protein, 869 aa, Homo sapiens
MDFPSSLRPALFLTGPLGLSDVPDLSFMCSWRDALTLPEAQPQNSENGALHVTKDLLWEPATPGPLPMLPPLIDPWDPGLTARDLLFRGGCRYRKRPRVVLDVTEQISRFLLDHGDVAFAPLGKLMLENFKLEGAGSRTKKKTVVSVKKLLQDLGGHQPWGCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGESKALIYTFLPHWLTCYLTPGPFHPSSALLAVRSDYHCAVWKFGKQWQPTLLQAMQVEKGATGISLSPHLPGELAICSRSGAVCLWSPEDGLRQIYRDPETLVFRDSSSWRWADFTAHPRVLTVGDRTGVKMLDTQGPPGCGLLLFRLGAEASCQKGERVLLTQYLGHSSPKCLPPTLHLVCTQFSLYLVDERLPLVPMLKWNHGLPSPLLLARLLPPPRPSCVQPLLLGGQGGQLQLLHLAGEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 66493 - protein, 450 aa, Homo sapiens
MSDFSEELKGPVTDDEEVETSVLSGAGMHFPWLQTYVETVAIGGKRRKDFAQTTSACLSFIQEALLKHQWQQAAEYMYSYFQTLEDSDSYKRQAAPEIIWKLGSEILFYHPKSNMESFNTFANRMKNIGVMNYLKISLQHALYLLHHGMLKDAKRNLSEAETWRHGENTSSREILINLIQAYKGLLQYYTWSEKKMELSKLDKDDYAYNAVAQDVFNHSWKTSANISALIKIPGVWDPFVKSYVEMLEFYGDRDGAQEVLTNYAYDEKFPSNPNAHIYLYNFLKRQKAPRSKLISVLKILYQIVPSHKLMLEFHTLLRKSEKEEHRKLGLEVLFGVLDFAGCTKNITAWKYLAKYLKNILMGNHLAWVQEEWNSRKNWWPGFHFSYFWAKSDWKEDTALACEKAFVAGLLLGKGCRYFRYILKQDHQILGKKIKRMKRSVKKYSIVNPRL

SEQ ID NO: 66494 - protein, 450 aa, Homo sapiens; identical to SEQ ID NO: 66493

SEQ ID NO: 66495 - protein, 336 aa, Homo sapiens
MESFNTFANRMKNIGVMNYLKISLQHALYLLHHGMLKDAKRNLSEAETWRHGENTSSREILINLIQAYKGLLQYYTWSEKKMELSKLDKDDYAYNAVAQDVFNHSWKTSANISALIKIPGVWDPFVKSYVEMLEFYGDRDGAQEVLTNYAYDEKFPSNPNAHIYLYNFLKRQKAPRSKLISVLKILYQIVPSHKLMLEFHTLLRKSEKEEHRKLGLEVLFGVLDFAGCTKNITAWKYLAKYLKNILMGNHLAWVQEEWNSRKNWWPGFHFSYFWAKSDWKEDTALACEKAFVAGLLLGKGCRYFRYILKQDHQILGKKIKRMKRSVKKYSIVNPRL

SEQ ID NO: 66496 - protein, 336 aa, Homo sapiens; identical to SEQ ID NO: 66495

SEQ ID NO: 66497 - protein, 286 aa, Homo sapiens
MSDFSEELKGPVTDDEEVETSVLSGAGMHFPWLQTYVETVAIGGKRRKDFAQTTSACLSFIQEALLKHQWQQAAEYMYSYFQTLEDSDSYKRQAAPEISLQHALYLLHHGMLKDAKRNLSEAETWRHGENTSSREILINLIQAYKGLLQYYTWSEKKMELSKLDKDDYAYNAVAQDVFNHSWKTSANISALIKIPGVWDPFVKSYVEMLEFYGDRDGAQEVLTNYAYDEKFPSNPNAHIYLYNFLKRQKAPRSKLISVLKILYQIVPSHKLMLEFHTLLRKSEKEE

SEQ ID NO: 66498 - protein, 282 aa, Homo sapiens
MSDFSEELKGPVTDDEEVETSVLSGAGMHFPWLQTYVETVAIGGKRRKDFAQTTSACLSFIQEALLKHQWQQAAEYMYSYFQTLEDSDSYKRQAAPEISLQHALYLLHHGMLKDAKRNLSEAETWRHGENTSSREILINLIQAYKGLLQYYTWSEKKMELSKLDKDDYAYNAVAQDVFNHSWKTSANISALIKIPGVWDPFVKSYVEMLEFYGDRDGAQEVLTNYAYDEKFPSNPNAHIYLYNFLKRQKAPRSKLISVLKILYQIVPSHKLMLEFHTLLRKS

SEQ ID NO: 66499 - protein, 311 aa, Homo sapiens
MSDFSEELKGPVTDDEEVETSVLSGAGMHFPWLQTYVETVAIGGKRRKDFAQTTSACLSFIQEALLKHQWQQAAEYMYSYFQTLEDSDSYKRQAAPEIIWKLGSEILFYHPKSNMESFNTFANRMKNIGVMNYLKISLQHALYLLHHGMLKDAKRNLSEAETWRHGENTSSREILINLIQAYKGLLQYYTWSEKKMELSKLDKDDYAYNAVAQDVFNHSWKTSANISALIKIPGVWDPFVKSYVEMLEFYGDRDGAQEVLTNYAYDEKFPSNPNAHIYLYNFLKRQKAPRSKLISVLKHLQKISIMYSTLR

SEQ ID NO: 66500 - protein, 775 aa, Homo sapiens
MLPPLIDPWDPGLTARDLLFRGGCRYRKRPRVVLDVTEQISRFLLDHGDVAFAPLGKLMLENFKLEGAGSRTKKKTVVSVKKLLQDLGGHQPWGCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGETLLAVRSDYHCAVWKFGKQWQPTLLQAMQVEKGATGISLSPHLPGELAICSRSGAVCLWSPEDGLRQIYRDPETLVFRDSSSWRWADFTAHPRVLTVGDRTGVKMLDTQGPPGCGLLLFRLGAEASCQKGERVLLTQYLGHSSPKCLPPTLHLVCTQFSLYLVDERLPLVPMLKWNHGLPSPLLLARLLPPPRPSCVQPLLLGGQGGQLQLLHLAEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 66501 - protein, 869 aa, Homo sapiens; identical to SEQ ID NO: 66492

SEQ ID NO: 66502 - protein, 348 aa, Homo sapiens
MDFPSSLRPALFLTGPLGLSDVPDLSFMCSWRDALTLPEAQPQNSENGALHVTKDLLWEPATPGPLPMLPPLIDPWDPGLTARDLLFRGGCRYRKRPRVVLDVTEQISRFLLDHGDVAFAPLGKLMLENFKLEGAGSRTKKKTVVSVKKLLQDLGGHQPWGCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGETLLAVRSDYHCAVWKFGKQWQPTLLQAMQVEKGATGISLSPHLPGELAICSRSGAVCLWSPEDGYRRFL

SEQ ID NO: 66503 - protein, 776 aa, Homo sapiens
MLPPLIDPWDPGLTARDLLFRGGCRYRKRPRVVLDVTEQISRFLLDHGDVAFAPLGKLMLENFKLEGAGSRTKKKTVVSVKKLLQDLGGHQPWGCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGETLLAVRSDYHCAVWKFGKQWQPTLLQAMQVEKGATGISLSPHLPGELAICSRSGAVCLWSPEDGLRQIYRDPETLVFRDSSSWRWADFTAHPRVLTVGDRTGVKMLDTQGPPGCGLLLFRLGAEASCQKGERVLLTQYLGHSSPKCLPPTLHLVCTQFSLYLVDERLPLVPMLKWNHGLPSPLLLARLLPPPRPSCVQPLLLGGQGGQLQLLHLAGEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 66504 - protein, 392 aa, Homo sapiens
MLKWNHGLPSPLLLARLLPPPRPSCVQPLLLGGQGGQLQLLHLAEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 66505 - protein, 278 aa, Homo sapiens
MDKSGIDSLDHVTSDAVELANRSDNSSDSSLFKTQCIPYSPKGEKRNPIRKFVRTPESVHASDSSSDSSFEPIPLTIKAIFERFKNRKKRYKKKKKRRYQPTGRPRGRPEGRRNPIYSLIDKKKQFRSRGSGFPFLESENEKNAPWRKILTFEQAVARGFFNYIEKLKYEHHLKESLKQMNVGEDLENEDFDSRRYKFLDDDGSISPIEESTAEDEDATHLEDNECDIKLAGDSFIVSSEFPVRLSVYLEEEDITEEAALSKKRATKAKNTGQRGLKM

SEQ ID NO: 66506 - protein, 278 aa, Homo sapiens; identical to SEQ ID NO: 66505

SEQ ID NO: 66507 - protein, 278 aa, Homo sapiens; identical to SEQ ID NO: 66505

SEQ ID NO: 66508 - protein, 8 aa, Homo sapiens
MDKSGIDS

SEQ ID NO: 66509 - protein, 1009 aa, Homo sapiens
MSWFNASQLSSFAKQALSQAQKSIDRVLDIQEEEPSIWAETIPYGEPGISSPVSGGWDTSTWGLKSNTEPQSPPIASPKAITKPVRRTVVDESENFFSAFLSPTVSLKVSESVIDVKTTMESISNTSTQSLTAETKDIALEPKEQKHEDRQSNTPSPPVSTFSSGTSTTSDIEVLDHESVISESSASSRQETTDSKSSLHLMQTSFQLLSASACPEYNRLDDFQKLTESCCSSDAFERIDSFSVQSLDSRSVSEINSDDELSGKGYALVPIIVNSSTPKSKTVESAEGKSEEVNETLVIPTEEAEMEESGRSATPVNCEQPDILVSSTPINEGQTVLDKVAEQCEPAESQPEALSEKEDVCKVTLTVEFLNEKLEKREAQLLSLSKEKALLEEAFDNLKDEMFRVKEESSSISSLKDEFTQRIAEAEKKVQLACKERDAAKKEIKNIKEELATRLNSSETADLLKEKDEQIRGLMEEGEKLSKQQLHNSNIIKKLRAKDKENENMVAKLNKKVKELEEELQHLKQVLDGKEEVEKQHRENIKKLNSMVERQEKDLGRLQVDMDELEEKNRSIQAALDSAYKELTDLHKANAAKDSEAQEAALSREMKAKEELSAALEKAQEEARQQQETLAIQVGDLRLALQRTEQAAARKEDYLRHEIGELQQRLQEAENRNQELSQSVSSTTRPLLRQIENLQATLGSQTSSWEKLEKNLSDRLGESQTLLAAAVERERAATEELLANKIQMSSMESQNSLLRQENSRFQAQLESEKNRLCKLEDENNRYQVELENLKDEYVRTLEETRKEKTLLNSQLEMERMKVEQERKKAIFTQETIKEKERKPFSVSSTPTMSRSSSISGVDMAGLQTSFLSQDESHDHSFGPMPISANGSNLYDAVRMGAGSSIIENLQSQLKLREGEITHLQLEIGNLEKTRSIMAEELVKLTNQNDELEEKVKEIPKLRTQLRDLDQRYNTILQMYGEKAEEAEELRLDLEDVKNMYKTQIDELLRQSLS

SEQ ID NO: 66510 - protein, 1093 aa, Homo sapiens
MSWFNASQLSSFAKQALSQAQKSIDRVLDIQEEEPSIWAETIPYGEPGISSPVSGGWDTSTWGLKSNTEPQSPPIASPKAITKPVRRTVVDESENFFSAFLSPTDVQTIQKSPVVSKPPAKSQRPEEEVKSSLHESLHIGQSRTPETTESQVKDSSLCVSGETLAAGTSSPKTEGKHEETVNKESDMKVPTVSLKVSESVIDVKTTMESISNTSTQSLTAETKDIALEPKEQKHEDRQSNTPSPPVSTFSSGTSTTSDIEVLDHESVISESSASSRQETTDSKSSLHLMQTSFQLLSASACPEYNRLDDFQKLTESCCSSDAFERIDSFSVQSLDSRSVSEINSDDELSGKGYALVPIIVNSSTPKSKTVESAEGKSEEVNETLVIPTEEAEMEESGRSATPVNCEQPDILVSSTPINEGQTVLDKVAEQCEPAESQPEALSEKEDVCKTVEFLNEKLEKREAQLLSLSKEKALLEEAFDNLKDEMFRVKEESSSISSLKDEFTQRIAEAEKKVQLACKERDAAKKEIKNIKEELATRLNSSETADLLKEKDEQIRGLMEEGEKLSKQQLHNSNIIKKLRAKDKENENMVAKLNKKVKELEEELQHLKQVLDGKEEVEKQHRENIKKLNSMVERQEKDLGRLQVDMDELEEKNRSIQAALDSAYKELTDLHKANAAKDSEAQEAALSREMKAKEELSAALEKAQEEARQQQETLAIQVGDLRLALQRTEQAAARKEDYLRHEIGELQQRLQEAENRNQELSQSVSSTTRPLLRQIENLQATLGSQTSSWEKLEKNLSDRLGESQTLLAAAVERERAATEELLANKIQMSSMESQNSLLRQENSRFQAQLESEKNRLCKLEDENNRYQVELENLKDEYVRTLEETRKEKTLLNSQLEMERMKVEQERKKAIFTQETIKEKERKPFSVSSTPTMSRSSSISGVDMAGLQTSFLSQDESHDHSFGPMPISANGSNLYDAVRMGAGSSIIENLQSQLKLREGEITHLQLEIGNLEKTRSIMAEELVKLTNQNDELEEKVKEIPKLRTQLRDLDQRYNTILQMYGEKAEEAEELRLDLEDVKNMYKTQIDELLRQSLS

SEQ ID NO: 66511 - protein, 533 aa, Homo sapiens
MSWFNASQLSSFAKQALSQAQKSIDRVLDIQEEEPSIWAETIPYGEPGISSPVSGGWDTSTWGLKSNTEPQSPPIASPKAITKPVRRTVVDESENFFSAFLSPTDVQTIQKSPVVSKPPAKSQRPEEEVKSSLHESLHIGQSRTPETTESQVKDSSLCVSGETLAAGTSSPKTEGKHEETVNKESDMKVPTVSLKVSESVIDVKTTMESISNTSTQSLTAETKDIALEPKEQKHEDRQSNTPSPPVSTFSSGTSTTSDIEVLDHESVISESSASSRQETTDSKSSLHLMQTSFQLLSASACPEYNRLDDFQKLTESCCSSDAFERIDSFSVQSLDSRSVSEINSDDELSGKGYALVPIIVNSSTPKSKTVESAEGKSEEVNETLVIPTEEAEMEESGRSATPVNCEQPDILVSSTPINEGQTVLDKVAEQCEPAESQPEALSEKEDVCKTVEFLNEKLEKREAQLLSLSKEKALLEEAFDNLKDEMFRVKEESSSISSLKDEFTQRIAEAEKKVQLACKERDAAKKEVKRKKR

SEQ ID NO: 66512 - protein, 1096 aa, Homo sapiens
MSWFNASQLSSFAKQALSQAQKSIDRVLDIQEEEPSIWAETIPYGEPGISSPVSGGWDTSTWGLKSNTEPQSPPIASPKAITKPVRRTVVDESENFFSAFLSPTDVQTIQKSPVVSKPPAKSQRPEEEVKSSLHESLHIGQSRTPETTESQVKDSSLCVSGETLAAGTSSPKTEGKHEETVNKESDMKVPTVSLKVSESVIDVKTTMESISNTSTQSLTAETKDIALEPKEQKHEDRQSNTPSPPVSTFSSGTSTTSDIEVLDHESVISESSASSRQETTDSKSSLHLMQTSFQLLSASACPEYNRLDDFQKLTESCCSSDAFERIDSFSVQSLDSRSVSEINSDDELSGKGYALVPIIVNSSTPKSKTVESAEGKSEEVNETLVIPTEEAEMEESGRSATPVNCEQPDILVSSTPINEGQTVLDKVAEQCEPAESQPEALSEKEDVCKVTLTVEFLNEKLEKREAQLLSLSKEKALLEEAFDNLKDEMFRVKEESSSISSLKDEFTQRIAEAEKKVQLACKERDAAKKEIKNIKEELATRLNSSETADLLKEKDEQIRGLMEEGEKLSKQQLHNSNIIKKLRAKDKENENMVAKLNKKVKELEEELQHLKQVLDGKEEVEKQHRENIKKLNSMVERQEKDLGRLQVDMDELEEKNRSIQAALDSAYKELTDLHKANAAKDSEAQEAALSREMKAKEELSAALEKAQEEARQQQETLAIQVGDLRLALQRTEQAAARKEDYLRHEIGELQQRLQEAENRNQELSQSVSSTTRPLLRQIENLQATLGSQTSSWEKLEKNLSDRLGESQTLLAAAVERERAATEELLANKIQMSSMESQNSLLRQENSRFQAQLESEKNRLCKLEDENNRYQVELENLKDEYVRTLEETRKEKTLLNSQLEMERMKVEQERKKAIFTQETIKEKERKPFSVSSTPTMSRSSSISGVDMAGLQTSFLSQDESHDHSFGPMPISANGSNLYDAVRMGAGSSIIENLQSQLKLREGEITHLQLEIGNLEKTRSIMAEELVKLTNQNDELEEKVKEIPKLRTQLRDLDQRYNTILQMYGEKAEEAEELRLDLEDVKNMYKTQIDELLRQSLS

SEQ ID NO: 66513 - protein, 1649 aa, Homo sapiens
MESVEKDWGWGLWRNLRCLGHAHQGKCCTEGGISSTTKTSSENGSCCFEKAARKDHVCRFIGCGRNDRFNYVVMQLQGRNLADLRRSQSRGTFTISTTLRLGRQILESIESIHSVGFLHRDIKPSNFAMGRFPSTCRKCYMLDFGLARQFTNSCGDVRPPRAVAGFRGTVRYASINAHRNREMGRHDDLWSLFYMLVEFVVGQLPWRKIKDKEQVGSIKERYDHRLMLKHLPPEFSIFLDHISSLDYFTKPDYQMSIRVTRKSYKVSTSGPQAFNSLSYTSGPGACISSSSFSRMGSSSFRGGLGAGYGGASGGITTITVNQSLLSPLNLEVDPNIQAVRTQEEKQIKTLNNKFFSFIDKVRFLEQQNKMLETKWSLVQQQKMARSNMDNMFESYINNLKWQLETLGQEKLKLEAELGNMHGLVEDFRNKYEVEISKCTEMENEFVLIKEYVDEAYMNKMELESSLKELTAKISFLRQLYEEEIGSCSPRSRIHLWCCSWTTAASWTWTASSLRSRPEGFPGGCHADTEQRGELAIKDANAKLSELEAALQLASQDMARQLREYQELMNVKLALDIKIATYRKLLEGEESWLESGMQNMSIHMKTTSSYAGGQSLAYGGLTSPGLSYGLGSSFGSGMGSSSFSHTSSSRAVVMKKIETRDGKLVSESSNVLPNLRITATLLTSVFDNSIKTFGVIESDPFDWEKTGNDGSLTTTTTSTTPQLHTRLTPAAIGIANATPIPGDLLRENTDEVFPDEQLSDGENGIPVGVSPDKLPGSLGHPRPQEKDVWEEMDANKNKIKLGICKAATEEENSHGQANGLLNAPSLGSPIRVRSEITQPDRDIPLVRKLRSIHSFELEKRLTLEPKPDTDKFLETCLEKMQKDTSAGKESILPALLHKPCVPAVSRTDHIWHYDEEYLPDASKPASANTPEQADGGGSNGFIAVNLSSCKQEIDSKEWVIVDKEQDLQDFRTNEAVGHKTTGSPSDEEPEVLQVLEASPQDEKLQLGPWAENDHLKKETSGVVLALSAEGPPTAASEQYTDRLELQPGAASQFIAATPTSLMEAQAEGPLTAITIPRPSVASTQSTSGSFHCGQQPEKKDLQPMEPTVELYSPRENFSGLVVTEGEPPSGGSRTDLGLQIDHIGHDMLPNIRESNKSQDLGPKELPDHNRLVVREFENLPGETEEKSILLESDNEDEKLSRGQHCIEISSLPGDLVIVEKDHSATTEPLDVTKTQTFSVVPNQDKNNEIMKLLTVGTSEISSRDIDPHVEGQIGQVAEMQKNKISKDDDIMSEDLPGHQGDLSTFLHQEGKREKITPRNGELFHCVSENEHGAPTRKDMVRSSFVTRHSRIPVLAQEIDSTLESSSPVSAKEKLLQKKAYQPDLVKLLVEKRQFKSFLGDLSSASDKLLEEKLATVPAPFCEEEVLTPFSRLTVDSHLSRSAEDSFLSPIISQSRKSKIPRPVSWVNTDQVNSSTSSQFFPRPPPGKPPTRPGVEARLRRYKVLGSSNSDSDLFSRLAQILQNGSQKPRSTTQCKSPGSPHNPKTPPKSPVVPRRSPSASPRSSSLPRTSSSSPSRAGRPHHDQRSSSPHLGRSKSPPSHSGSSSSRRSCQQEHCKPSKNGLKGSGSLHHHSASTKTPQGKSKPASKLSR

SEQ ID NO: 66514 - protein, 1244 aa, Homo sapiens
MSGGGEQLDILSVGILVKERWKVLRKIGGGGFGEIYDALDMLTRENVALKVESAQQPKQVLKMEVAVLKKLQGKDHVCRFIGCGRNDRFNYVVMQLQGRNLADLRRSQSRGTFTISTTLRLGRQILESIESIHSVGFLHRDIKPSNFAMGRFPSTCRKCYMLDFGLARQFTNSCGDVRPPRAVAGFRGTVRYASINAHRNREMGRHDDLWSLFYMLVEFVVGQLPWRKIKDKEQVGSIKERYDHRLMLKHLPPEFSIFLDHISSLDYFTKPDYQLLTSVFDNSIKTFGVIESDPFDWEKTGNDGSLTTTTTSTTPQLHTRLTPAAIGIANATPIPGDLLRENTDEVFPDEQLSDGENGIPVGVSPDKLPGSLGHPRPQEKDVWEEMDANKNKIKLGICKAATEEENSHGQANGLLNAPSLGSPIRVRSEITQPDRDIPLVRKLRSIHSFELEKRLTLEPKPDTDKFLETCLEKMQKDTSAGKESILPALLHKPCVPAVSRTDHIWHYDEEYLPDASKPASANTPEQADGGGSNGFIAVNLSSCKQEIDSKEWVIVDKEQDLQDFRTNEAVGHKTTGSPSDEEPEVLQVLEASPQDEKLQLGPWAENDHLKKETSGVVLALSAEGPPTAASEQYTDRLELQPGAASQFIAATPTSLMEAQAEGPLTAITIPRPSVASTQSTSGSFHCGQQPEKKDLQPMEPTVELYSPRENFSGLVVTEGEPPSGGSRTDLGLQIDHIGHDMLPNIRESNKSQDLGPKELPDHNRLVVREFENLPGETEEKSILLESDNEDEKLSRGQHCIEISSLPGDLVIVEKDHSATTEPLDVTKTQTFSVVPNQDKNNEIMKLLTVGTSEISSRDIDPHVEGQIGQVAEMQKNKISKDDDIMSEDLPGHQGDLSTFLHQEGKREKITPRNGELFHCVSENEHGAPTRKDMVRSSFVTRHSRIPVLAQEIDSTLESSSPVSAKEKLLQKKAYQPDLVKLLVEKRQFKSFLGDLSSASDKLLEEKLATVPAPFCEEEVLTPFSRLTVDSHLSRSAEDSFLSPIISQSRKSKIPRPVSWVNTDQVNSSTSSQFFPRPPPGKPPTRPGVEARLRRYKVLGSSNSDSDLFSRLAQILQNGSQKPRSTTQCKSPGSPHNPKTPPKSPVVPRRSPSASPRSSSLPRTSSSSPSRAGRPHHDQRSSSPHLGRSKSPPSHSGSSSSRRSCQQEHCKPSKNGLKGSGSLHHHSASTKTPQGKSKPASKLSR

SEQ ID NO: 66515 - protein, 1174 aa, Homo sapiens
EPGKDHVCRFIGCGRNDRFNYVVMQLQGRNLADLRRSQSRGTFTISTTLRLGRQILESIESIHSVGFLHRDIKPSNFAMGRFPSTCRKCYMLDFGLARQFTNSCGDVRPPRAVAGFRGTVRYASINAHRNREMGRHDDLWSLFYMLVEFVVGQLPWRKIKDKEQVGSIKERYDHRLMLKHLPPEFSIFLDHISSLDYFTKPDYQLLTSVFDNSIKTFGVIESDPFDWEKTGNDGSLTTTTTSTTPQLHTRLTPAAIGIANATPIPGDLLRENTDEVFPDEQLSDGENGIPVGVSPDKLPGSLGHPRPQEKDVWEEMDANKNKIKLGICKAATEEENSHGQANGLLNAPSLGSPIRVRSEITQPDRDIPLVRKLRSIHSFELEKRLTLEPKPDTDKFLETCLEKMQKDTSAGKESILPALLHKPCVPAVSRTDHIWHYDEEYLPDASKPASANTPEQADGGGSNGFIAVNLSSCKQEIDSKEWVIVDKEQDLQDFRTNEAVGHKTTGSPSDEEPEVLQVLEASPQDEKLQLGPWAENDHLKKETSGVVLALSAEGPPTAASEQYTDRLELQPGAASQFIAATPTSLMEAQAEGPLTAITIPRPSVASTQSTSGSFHCGQQPEKKDLQPMEPTVELYSPRENFSGLVVTEGEPPSGGSRTDLGLQIDHIGHDMLPNIRESNKSQDLGPKELPDHNRLVVREFENLPGETEEKSILLESDNEDEKLSRGQHCIEISSLPGDLVIVEKDHSATTEPLDVTKTQTFSVVPNQDKNNEIMKLLTVGTSEISSRDIDPHVEGQIGQVAEMQKNKISKDDDIMSEDLPGHQGDLSTFLHQEGKREKITPRNGELFHCVSENEHGAPTRKDMVRSSFVTRHSRIPVLAQEIDSTLESSSPVSAKEKLLQKKAYQPDLVKLLVEKRQFKSFLGDLSSASDKLLEEKLATVPAPFCEEEVLTPFSRLTVDSHLSRSAEDSFLSPIISQSRKSKIPRPVSWVNTDQVNSSTSSQFFPRPPPGKPPTRPGVEARLRRYKVLGSSNSDSDLFSRLAQILQNGSQKPRSTTQCKSPGSPHNPKTPPKSPVVPRRSPSASPRSSSLPRTSSSSPSRAGRPHHDQRSSSPHLGRSKSPPSHSGSSSSRRSCQQEHCKPSKNGLKGSGSLHHHSASTKTPQGKSKPASKLSR

SEQ ID NO: 66516 - protein, 747 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 66517 - protein, 789 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEGQNSQSPQCFKTCSEQNGYVLTLSNAQPVLQYGNPYASQETRDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 66518 - protein, 138 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNS

SEQ ID NO: 66519 - protein, 98 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGE

SEQ ID NO: 66520 - protein, 590 aa, Homo sapiens
MKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 66521 - protein, 747 aa, Homo sapiens; identical to SEQ ID NO: 66516

SEQ ID NO: 66522 - protein, 1159 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERNVDPSPVGESKHRPGQSSAPAPPPRLNPSASSPNFFKYLKHNSSGEQSGNAVPKSISYRNALRKKLHSSSSVPNFLKFLAPVDENNTSDFMNTKRDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 66523 - protein, 1168 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 66524 - protein, 432 aa, Homo sapiens
MEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 66525 - protein, 310 aa, Homo sapiens
MAQALGEDLVQPPELQDDSSSLGSDSELSGPGPYRQADRYGFIGGSSAEPGPGHPPADLIRQREMKWVEMTSHWEKTMSRRYKKVKMQCRKGIPSALRARCWPLLCGAHVCQKNSPGTYQELAEAPGDPQWMETIGRDLHRQFPLHEMFVSPQGHGRGSCRCSRPTPCIDRSRATARPRGPWLLCCSCTCPQRRPSGAWCRSVRSTSLGTTGPTWCQSTVPCGADTGAPGAGHCRAARGLPWPPGDTGSPSSHPPRAAAGGGLHVTGAQRGAVRAGPAAGDQGPAGPAARFRAGTPAPATGPPRRGPSHL

SEQ ID NO: 66526 - protein, 553 aa, Homo sapiens
MDSPGYNCFVDKDKMDAAIQDLGPKELSCTELQELKQLARQGYWAQSHALRGKVYQRLIRDIPCRTVTPDASVYSDIVGKIVGKHSSSCLPLPEFVDNTQVPSYCLNARGEGAVRKILLCLANQFPDISFCPALPAVVALLLHYSIDEAECFEKACRILACNDPGRRLIDQSFLAFESSCMTFGDLVNKYCQAAHKLMVAVSEDVLQVYADWQRWLFGELPLCYFARVFDVFLVEGYKVLYRVALAILKFFHKVRAGQPLESDSVKQDIRTFVRDIAKTVSPEKLLEKAFAIRLFSRKEIQLLQMANEKALKQKGITVKQKRQFVHLAVHAENFRSEIVSVREMRDIWSWVPERFALCQPLLLFSSLQHGYSLARFYFQCEGHEPTLLLIKTTQKEVCGAYLSTDWSERNKFGGKLGFFGTGECFVFRLQPEVQRYEWVVIKHPELTKPPPLMAAEPTAPLSHSASSDPADRLSPFLAARHFNLPSKTESMFMAGGSDCLIVGGGGGQALYIDGDLNRGRTSHCDTFNNQPLCSENFLIAAVEAWGFQDPDTQ

SEQ ID NO: 66527 - protein, 508 aa, Homo sapiens
MAKSNGENGPRAPAAGESLSGTRESLAQGPDAATTDELSSLGSDSEANGFAERRIDKFGFIVGSQGAEGALEEVPLEVLRQRESKWLDMLNNWDKWMAKKHKKIRLRCQKGIPPSLRGRAWQYLSGGKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVVELPVTERQIEREHLIQLRRWQETRGELQCRSPPRLHGAKAILDAEPGPRPALQPSPSIRLPLDAPLPGSKAKPKPPKQAQKEQRKQMKGRGQLEKPPAPNQAMVVAAAGDACPPQHVPPKDSAPKDSAPQDLAPQVSAHHRSQESLTSQESEDTYL

SEQ ID NO: 66528 - protein, 420 aa, Homo sapiens
MLNNWDKWMAKKHKKIRLRCQKGIPPSLRGRAWQYLSGGKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVVELPVTERQIEREHLIQLRRWQETRGELQCRSPPRLHGAKAILDAEPGPRPALQPSPSIRLPLDAPLPGSKAKPKPPKQAQKEQRKQMKGRGQLEKPPAPNQAMVVAAAGDACPPQHVPPKDSAPKDSAPQDLAPQVSAHHRSQESLTSQESEDTYL

SEQ ID NO: 66529 - protein, 515 aa, Homo sapiens
MAKSNGENGPRAPAAGESLSGTRESLAQGPDAATTDELSSLGSDSEANGFAERRIDKFGFIVGSQGAEGAPCPLLHRLEEVPLEVLRQRESKWLDMLNNWDKWMAKKHKKIRLRCQKGIPPSLRGRAWQYLSGGKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVVELPVTERQIEREHLIQLRRWQETRGELQCRSPPRLHGAKAILDAEPGPRPALQPSPSIRLPLDAPLPGSKAKPKPPKQAQKEQRKQMKGRGQLEKPPAPNQAMVVAAAGDACPPQHVPPKDSAPKDSAPQDLAPQVSAHHRSQESLTSQESEDTYL

SEQ ID NO: 66530 - protein, 808 aa, Homo sapiens
METGTAPLVAPPRRHGAPAAPSPPPRGSRAGPVVVVAPGPPVTTATSAPVTLVAPGEARPAWVPGSAETSAPAPAPAPAPAPAVTGSTVVVLTLEASPEAPKPQLPSGPESPEPAAVAGVETSRALAAGADSPKTEEARPSPAPGPGTPTGTPTRTPSRTAPGALTAKPPLAPKPGTTVASGVTARSASGQVTGGHGAAAATSASAGQAPEDPSGPGTGPSGTCEAPVAVVTVTPAPEPAENSQDLGSTSSLGPGISGPRGQAPDTLSYLDSVSLMSGTLESLADDVSSMGSDSEINGLALRKTDKYGFLGGSQYSGSLESSIPVDVARQRELKWLDMFSNWDKWLSRRFQKVKLRCRKGIPSSLRAKAWQYLSNSKELLEQNPGKFEELERAPGDPKWLDVIEKDLHRQFPFHEMFAARGGHGQQDLYRILKAYTIYRPDEGYCQAQAPVAAVLLMHMPAEQAFWCLVQICDKYLPGYYSAGLEAIQLDGEIFFALLRRASPLAHRHLRRQRIDPVLYMTEWFMCIFARTLPWASVLRVWDMFFCEGVKIIFRVALVLLRHTLGSVEKLRSCQGMYETMEQLRNLPQQCMQEDFLVHEVTNLPVTEALIERENAAQLKKWRETRGELQYRPSRRLHGSRAIHEERRRQQPPLGPSSSLLSLPGLKSRGSRAAGGAPSPPPPVRRASAGPAPGPVVTAEGLHPSLPSPTGNSTPLGSSKETRKQEKERQKQEKERQKQEKEREKERQKQEKEREKQEKEREKQEKERQKQEKKAQGRKLSLRRKADGPPGPHDGGDRPSAEARQDAYF

SEQ ID NO: 66531 - protein, 446 aa, Homo sapiens
MAQALGEDLVQPPELQDDSSSLGSDSELSGPGPYRQADRYGFIGGSSAEPGPGHPPADLIRQREMKWVEMTSHWEKTMSRRYKKVKMQCRKGIPSALRARCWPLLCGAHVCQKNSPGTYQELAEAPGDPQWMETIGRDLHRQFPLHEMFVSPQGHGQQGLLQVLKAYTLYRPEQGYCQAQGPVAAVLLMHLPPEEAFWCLVQICEVYLPGYYGPHMEAVRLDAEVFMALLRRLLPHVHKHLQQVGVGPLLYLPEWFLCLFARSLPFPTVLRVWDAFLSEGARVLFRVGLTLVRLALGTAEQRGACPGLLETLGALRAIPPAQLQEEAFMSQVHSVVLSERDLQREIKAQLAQLPDSAPGPPPRPQVRLAGAQAIFEAQQLAGVRRGAKPEVPRIVVQPPEEPRPPRRKPQTRGKTFHGLLTRARGPPIEGPPRPQRGSTSFLDTRF

SEQ ID NO: 66532 - protein, 446 aa, Homo sapiens; identical to SEQ ID NO: 66531

SEQ ID NO: 66533 - protein, 682 aa, Homo sapiens
MCPGLYPYSSLLEYGRSMIIYEQEGVYIHSSCGKTNDQDGLISGILRVLEKDAEVIVDWRPLDDALDSSSILYARKDSSSVVEWTQAPKERGHRGSEHLNSYEAEWDMVNTVSFKRKPHTNGDAPSHRNGKSKWSFLFSLTDLKSIKQNKEGMGWSYLVFCLKDDVVLPALHFHQGDSKLLIESLEKYVVLCESPQDKRTLLVNCQNKSLSQSFENLLDEPAYGLIQKIKKDPYTATMIGFSKVTNYIFDSLRGSDPSTHQRPPSEMADFLSDAIPGLKINQQEEPGFEVITRIDLGERPVVQRREPVSLEEWTKNIDSEGRILNVDNMKQMIFRGGLSHALRKQAWKFLLGYFPWDSTKEERTQLQKQKTDEYFRMKLQWKSISQEQEKRNSRLRDYRSLIEKDVNRTDRTNKFYEGQDNPGLILLHDILMTYCMYDFDLGYVQGMSDLLSPLLYVMENEVDAFWCFASYMDQMHQNFEEQMQGMKTQLIQLSTLLRLLDSGFCSYLESQDSGYLYFCFRWLLIRFKREFSFLDILRLWEVMWTELPCTNFHLLLCCAILESEKQQIMEKHYGFNEILKHINELSMKIDVEDILCKAEAISLQMVKCKELPQAVCEILGLQGSEVTTPDSDVGEDENVVMTPCPTSAFQSNALPTLSASGARNDSPTQIPVSSDVCRLTPA

SEQ ID NO: 66534 - protein, 445 aa, Homo sapiens
MIGFSKVTNYIFDSLRGSDPSTHQRPPSEMADFLSDAIPGLKINQQEEPGFEVITRIDLGERPVVQRREPVSLEEWTKNIDSEGRILNVDNMKQMIFRGGLSHALRKQAWKFLLGYFPWDSTKEERTQLQKQKTDEYFRMKLQWKSISQEQEKRNSRLRDYRSLIEKDVNRTDRTNKFYEGQDNPGLILLHDILMTYCMYDFDLGYVQGMSDLLSPLLYVMENEVDAFWCFASYMDQMHQNFEEQMQGMKTQLIQLSTLLRLLDSGFCSYLESQDSGYLYFCFRWLLIRFKREFSFLDILRLWEVMWTELPCTNFHLLLCCAILESEKQQIMEKHYGFNEILKHINELSMKIDVEDILCKAEAISLQMVKCKELPQAVCEILGLQGSEVTTPDSDVGEDENVVMTPCPTSAFQSNALPTLSASGARNDSPTQIPVSSDVCRLTPA

SEQ ID NO: 66535 - protein, 674 aa, Homo sapiens
MAAAGVVSGKIIYEQEGVYIHSSCGKTNDQDGLISGILRVLEKDAEVIVDWRPLDDALDSSSILYARKDSSSVVEWTQAPKERGHRGSEHLNSYEAEWDMVNTVSFKRKPHTNGDAPSHRNGKSKWSFLFSLTDLKSIKQNKEGMGWSYLVFCLKDDVVLPALHFHQGDSKLLIESLEKYVVLCESPQDKRTLLVNCQNKSLSQSFENLLDEPAYGLIQKIKKDPYTATMIGFSKVTNYIFDSLRGSDPSTHQRPPSEMADFLSDAIPGLKINQQEEPGFEVITRIDLGERPVVQRREPVSLEEWTKNIDSEGRILNVDNMKQMIFRGGLSHALRKQAWKFLLGYFPWDSTKEERTQLQKQKTDEYFRMKLQWKSISQEQEKRNSRLRDYRSLIEKDVNRTDRTNKFYEGQDNPGLILLHDILMTYCMYDFDLGYVQGMSDLLSPLLYVMENEVDAFWCFASYMDQMHQNFEEQMQGMKTQLIQLSTLLRLLDSGFCSYLESQDSGYLYFCFRWLLIRFKREFSFLDILRLWEVMWTELPCTNFHLLLCCAILESEKQQIMEKHYGFNEILKHINELSMKIDVEDILCKAEAISLQMVKCKELPQAVCEILGLQGSEVTTPDSDVGEDENVVMTPCPTSAFQSNALPTLSASGARNDSPTQIPVSSDVCRLTPA

SEQ ID NO: 66536 - protein, 691 aa, Homo sapiens
MAAAGVVSGKIIYEQEGVYIHSSCGKTNDQDGLISGILRVLEKDAEVIVDWRPLDDALDSSSILYARKDSSSVVEWTQAPKERGHRGSEHLNSYEAEWDMVNTVSFKRKPHTNGDAPSHRNGKSKWSFLFSLTDLKSIKQNKEGMGWSYLVFCLKDDVVLPALHFHQGDSKLLIESLEKYVVLCESPQDKRTLLVNCQNKSLSQSFENLLDEPAYGLIQAGLLDRRKLLWAIHHWKKIKKDPYTATMIGFSKVTNYIFDSLRGSDPSTHQRPPSEMADFLSDAIPGLKINQQEEPGFEVITRIDLGERPVVQRREPVSLEEWTKNIDSEGRILNVDNMKQMIFRGGLSHALRKQAWKFLLGYFPWDSTKEERTQLQKQKTDEYFRMKLQWKSISQEQEKRNSRLRDYRSLIEKDVNRTDRTNKFYEGQDNPGLILLHDILMTYCMYDFDLGYVQGMSDLLSPLLYVMENEVDAFWCFASYMDQMHQNFEEQMQGMKTQLIQLSTLLRLLDSGFCSYLESQDSGYLYFCFRWLLIRFKREFSFLDILRLWEVMWTELPCTNFHLLLCCAILESEKQQIMEKHYGFNEILKHINELSMKIDVEDILCKAEAISLQMVKCKELPQAVCEILGLQGSEVTTPDSDVGEDENVVMTPCPTSAFQSNALPTLSASGARNDSPTQIPVSSDVCRLTPA

SEQ ID NO: 66537 - protein, 710 aa, Homo sapiens
MHNIRGNKQAQGTGHEPPGEDSPQSGEPQREEQPLASDASTPGREPEDSPKPAPKPSLTISFAQKAKRQNNTFPFFSEGITRNRTAQEKVAALEQQVLMLTKELKSQKELVKILHKALEAAQQEKRASSAYLAAAEDKDRLELVRHKVRQIAELGRRVEALEQERESLAHTASLREQQVQELQQHVQLLMDKNHAKQQVICKLSEKVTQDFTHPPDQSPLRPDAANRDFLSQQGKIEHLKDDMEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKVVFRYALAIFKYNEKEILRLQNGLEIYQYLRFFTKTISNSRKLMNIAFNDMNPFRMKQLRQLRMVHRERLEAELRELEQLKAEYLERRASRRRAVSEGCASEDEVEGEA

SEQ ID NO: 66538 - protein, 468 aa, Homo sapiens
MEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKVVFRYALAIFKYNEKEILRLQNGLEIYQYLRFFTKTISNSRKLMNIAFNDMNPFRMKQLRQLRMVHRERLEAELRELEQLKAEYLERRASRRRAVSEGCASEDEVEGEA

SEQ ID NO: 66539 - protein, 860 aa, Homo sapiens
MEGAGENAPESSSSAPGSEESARDPQVPPPEEESGDCARSLEAVPKKLCGYLSKFGGKGPIRGWKSRWFFYDERKCQLYYSRTAQDANPLDSIDLSSAVFDCKADAEEGIFEIKTPSRVITLKAATKQAMLYWLQQLQMKRWEFHNSPPAPPATPDAALAGNGPVLHLELGQEEAELEEFLCPVKTPPGLVGVAAALQPFPALQNISLKHLGTEIQNTMHNIRGNKQAQGTGHEPPGEDSPQSGEPQREEQPLASDASTPGREPEDSPKPAPKPSLTISFAQKAKRQNNTFPFFSEGITRNRTAQEKVAALEQQVLMLTKELKSQKELVKILHKALEAAQQEKRASSAYLAAAEDKDRLELVRHKVRQIAELGRRVEALEQERESLAHTASLREQQVQELQQHVQLLMDKNHAKQQVICKLSEKVTQDFTHPPDQSPLRPDAANRDFLSQQGKIEHLKDDMEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKVVFRYALAIFKYNEKEILRLQNGLEIYQYLRFFTKTISNSR

SEQ ID NO: 66540 - protein, 917 aa, Homo sapiens
MEGAGENAPESSSSAPGSEESARDPQVPPPEEESGDCARSLEAVPKKLCGYLSKFGGKGPIRGWKSRWFFYDERKCQLYYSRTAQDANPLDSIDLSSAVFDCKADAEEGIFEIKTPSRVITLKAATKQAMLYWLQQLQMKRWEFHNSPPAPPATPDAALAGNGPVLHLELGQEEAELEEFLCPVKTPPGLVGVAAALQPFPALQNISLKHLGTEIQNTMHNIRGNKQAQGTGHEPPGEDSPQSGEPQREEQPLASDASTPGREPEDSPKPAPKPSLTISFAQKAKRQNNTFPFFSEGITRNRTAQEKVAALEQQVLMLTKELKSQKELVKILHKALEAAQQEKRASSAYLAAAEDKDRLELVRHKVRQIAELGRRVEALEQERESLAHTASLREQQVQELQQHVQLLMDKNHAKQQVICKLSEKVTQDFTHPPDQSPLRPDAANRDFLSQQGKIEHLKDDMEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKYNEKEILRLQNGLEIYQYLRFFTKTISNSRKLMNIAFNDMNPFRMKQLRQLRMVHRERLEAELRELEQLKAEYLERRASRRRAVSEGCASEDEVEGEA

SEQ ID NO: 66541 - protein, 428 aa, Homo sapiens
MPSGCYVPRSEPRLLPAPPPAGARVGALRSAQGDGPTSGHWDGGAEKADFNAKRKKKVAEIHQALNSDPTDVAALRRMAISEGGLLTDEIRRKVWPKLLNVNANDPPPISGKNLRQMSKDYQQVLLDVRRSLRRFPPGMPEEQREGLQEELIDIILLILERNPQLHYYQGYHDIVVTFLLVVGERLATSLVEKLSTHHLRDFMDPTMDNTKHILNYLMPIIDQVNPELHDFMQSAEVGTIFALSWLITWFGHVLSDFRHVVRLYDFFLACHPLMPIYFAAVIVLYREQEVLDCDCDMASVHHLLSQIPQDLPYETLISRAGDLFVQFPPSELAREAAAQQQAERTAASTFKDFELASAQQRPDMVLRQRFRGLLRPEDRTKDVLTKPRTNRFVKLAVMGLTVALGAAALAVVKSALEWAPKFQLQLFP

SEQ ID NO: 66542 - protein, 403 aa, Homo sapiens
MALRSAQGDGPTSGHWDGGAEKADFNAKRKKKVAEIHQALNSDPTDVAALRRMAISEGGLLTDEIRRKVWPKLLNVNANDPPPISGKNLRQMSKDYQQVLLDVRRSLRRFPPGMPEEQREGLQEELIDIILLILERNPQLHYYQGYHDIVVTFLLVVGERLATSLVEKLSTHHLRDFMDPTMDNTKHILNYLMPIIDQVNPELHDFMQSAEVGTIFALSWLITWFGHVLSDFRHVVRLYDFFLACHPLMPIYFAAVIVLYREQEVLDCDCDMASVHHLLSQIPQDLPYETLISRAGDLFVQFPPSELAREAAAQQQAERTAASTFKDFELASAQQRPDMVLRQRFRGLLRPEDRTKDVLTKPRTNRFVKLAVMGLTVALGAAALAVVKSALEWAPKFQLQLFP

SEQ ID NO: 66543 - protein, 403 aa, Homo sapiens; identical to SEQ ID NO: 66542

SEQ ID NO: 66544 - protein, 553 aa, Homo sapiens; identical to SEQ ID NO: 66526

SEQ ID NO: 66545 - protein, 559 aa, Homo sapiens
MDSPGYNCFVDKDKMDAAIQDLGPKELSCTELQELKQLARQGYWAQSHALRGKVYQRLIRDIPCRTVTPDASVYSDIVGKIVGKHSSSCLPLPEFVDNTQVPSYCLNARGEGAVRKILLCLANQFPDISFCPALPAVVALLLHYSIDEAECFEKACRILACNDPGRRLIDQSFLAFESSCMTFGDLVNKYCQAAHKLMVAVSEDVLQVYADWQRWLFGELPLCYFARVFDVFLVEGYKVLYRVALAILKFFHKVRAGQPLESDSVKQDIRTFVRDIAKTVSPEKLLEKAFAIRLFSRKEIQLLQMANEKALKQKGITVKQKSVSLSKRQFVHLAVHAENFRSEIVSVREMRDIWSWVPERFALCQPLLLFSSLQHGYSLARFYFQCEGHEPTLLLIKTTQKEVCGAYLSTDWSERNKFGGKLGFFGTGECFVFRLQPEVQRYEWVVIKHPELTKPPPLMAAEPTAPLSHSASSDPADRLSPFLAARHFNLPSKTESMFMAGGSDCLIVGGGGGQALYIDGDLNRGRTSHCDTFNNQPLCSENFLIAAVEAWGFQDPDTQ

SEQ ID NO: 66546 - protein, 688 aa, Homo sapiens
MATASGASDLSGSGAPPPGVGAQAAAAAEEEEREVVRVRVKKCESFLPPEFRSFAVDPQITSLDVLQHILIRAFDLSGKKNFGISYLGRDRLGQEVYLSLLSDWDLSTAFATASKPYLQLRVDIRPSEDSPLLEDWDIISPKDVIGSDVLLAEKRSSLTTAALPFTQSILTQVGRTLSKVQQVLSWSYGEDVKPFKPPLSDAEFHTYLNHEGQLSRPEELRLRIYHGGVEPSLRKVVWRYLLNVYPDGLTGRERMDYMKRKSREYEQLKSEWAQRANPEDLEFIRSTVLKDVLRTDRAHPYYAGPEDGPHLRALHDLLTTYAVTHPQVSYCQGMSDLASPILAVMDHEGHAFVCFCGIMKRLAANFHPDGRAMATKFAHLKLLLRHADPDFYQYLQEAGADDLFFCYRWLLLELKREFAFDDALRMLEVTWSSLPPDPPEHEVELVGPPSQVADAGFGGHRGWPVRQRHMLRPAGGGGSTFEDAVDHLATASQGPGGGGRLLRQASLDGLQQLRDNMGSRRDPLVQLPHPAALISSKSLSEPLLNSPDPLLSSFSHPDSPSSSSPPSTQEASPTGDMAVGSPLMQEVGSPKDPGKSLPPVPPMGLPPPQEFGRGNPFMLFLCLAILLEHRDHIMRNGLDYNELAMHFDRLVRKHHLGRVLRRARALFADYLQSEVWDSEEGAEATAAS

SEQ ID NO: 66547 - protein, 230 aa, Homo sapiens
MATASGASDLSGSGAPPPGVGAQAAAAAEEEEREVVRVRVKHGDGAPGGLPHVFSPQKCESFLPPEFRSFAVDPQITSLDVLQHILIRAFDLSGKKNFGISYLGRDRLGQEVYLSLLSDWDLSTAFATASKPYLQLRVDIRPSEDSPLLEDWDIISPKDVIGSDVLLAEKRSSLTTAALPFTQSILTQVGRTLSKVQQVLSWSYGEDVKPFKPPLSDAEFHTYLNHEGQL

SEQ ID NO: 66548 - protein, 100 aa, Homo sapiens
MATASGASDLSGSGAPPPGVGAQAAAAAEEEEREVVRVRVKKCESFLPPEFRSFAVDPQITSLDVLQHILIRAFDLSGPIARRLGHNQPQRCHWLRRVAG

SEQ ID NO: 66549 - protein, 434 aa, Homo sapiens
MDYMKRKSREYEQLKSEWAQRANPEDLEFIRSTVLKDVLRTDRAHPYYAGPEDGPHLRALHDLLTTYAVTHPQVSYCQGMSDLASPILAVMDHEGHAFVCFCGIMKRLAANFHPDGRAMATKFAHLKLLLRHADPDFYQYLQEAGADDLFFCYRWLLLELKREFAFDDALRMLEVTWSSLPPDPPEHEVELVGPPSQVADAGFGGHRGWPVRQRHMLRPAGGGGSTFEDAVDHLATASQGPGGGGRLLRQASLDGLQQLRDNMGSRRDPLVQLPHPAALISSKSLSEPLLNSPDPLLSSFSHPDSPSSSSPPSTQEASPTGDMAVGSPLMQEVGSPKDPGKSLPPVPPMGLPPPQEFGRGNPFMLFLCLAILLEHRDHIMRNGLDYNELAMHFDRLVRKHHLGRVLRRARALFADYLQSEVWDSEEGAEATAAS

SEQ ID NO: 66550 - protein, 291 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQSASRRRPGVARGHVFATGSLIPGPGMRTLCSSILGPL

SEQ ID NO: 66551 - protein, 549 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 66552 - protein, 299 aa, Homo sapiens
MGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 66553 - protein, 527 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 66554 - protein, 549 aa, Homo sapiens; identical to SEQ ID NO: 66551

SEQ ID NO: 66555 - protein, 527 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYFPEEDAFWALVQLLASERHSLQGFHSPNGGTVQGLQDQQEHVVATSQSKTMGHQISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQYAPTSGPCLCGLHLESSQFPPGF

SEQ ID NO: 66556 - protein, 549 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYFPEEDAFWALVQLLASERHSLQGFHSPNGGTVQGLQDQQEHVVATSQSKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQYAPTSGPCLCGLHLESSQFPPGF

SEQ ID NO: 66557 - protein, 549 aa, Homo sapiens; identical to SEQ ID NO: 66556

SEQ ID NO: 66558 - protein, 549 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYLPEEDAFWALVQLLASERHSLQGFHSPNGGTVQGLQDQQEHVVATSQSKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPAWFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 66559 - protein, 527 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYLPEEDAFWALVQLLASERHSLQGFHSPNGGTVQGLQDQQEHVVATSQSKTMGHQISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPAWFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 66560 - protein, 549 aa, Homo sapiens; identical to SEQ ID NO: 66558

SEQ ID NO: 66561 - protein, 549 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 66562 - protein, 291 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQSASRRRPGVARGHVFATGSLIPGPGMRTLCSSILGPL

SEQ ID NO: 66563 - protein, 299 aa, Homo sapiens; identical to SEQ ID NO: 66552

SEQ ID NO: 66564 - protein, 469 aa, Homo sapiens
MLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 66565 - protein, 549 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 66566 - protein, 549 aa, Homo sapiens; identical to SEQ ID NO: 66565

SEQ ID NO: 66567 - protein, 527 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 66568 - protein, 527 aa, Homo sapiens; identical to SEQ ID NO: 66567

SEQ ID NO: 66569 - protein, 469 aa, Homo sapiens
MLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 66570 - protein, 469 aa, Homo sapiens
MLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPAWFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 66571 - protein, 549 aa, Homo sapiens
MDVVEVAGSWWAQEREDIIMKYEKGHQAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 66572 - protein, 469 aa, Homo sapiens; identical to SEQ ID NO: 66570

SEQ ID NO: 66573 - protein, 1235 aa, Homo sapiens
MEPPSCIQDEPFPHPLEPEPGVSAQPGPGKPSDKRFRLWYVGGSCLDHRTTLPMLPWLMAEIRRRSQKPEAGGCGAPAAREVILVLSAPFLRCVPAPGAGASGGTSPSATQPNPAVFIFEHKAQHISRFIHNSHDLTYFAYLIKAQPDDPESQMACHVFRATDPSQVPDVISSIRQLSKAAMKEDAKPSKDNEDAFYNSQKFEVLYCGKVTVTHKKAPSSLIDDCMEKFSLHEQQRLKIQGEQRGPDPGEDLADLEVVVPGSPGDCLPEEADGTDTHLGLPAGASQPALTSSRVCFPERILEDSGFDEQQEFRSRCSSVTGVQRRVHEGSQKSQPRRRHASAPSHVQPSDSEKNRTMLFQVGRFEINLISPDTKSVVLEKNFKDISSCSQGIKHVDHFGFICRESPEPGLSQYICYVFQCASESLVDEVMLTLKQAFSTAAALQSAKTQIKLCEACPMHSLHKLCERIEGLYPPRAKLVIQRHLSSLTDNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSDGEGRKRTSSTCSNESLSVGGTSVTPRRISWRQRIFLRVASPMNKSPSAMQQQDGLDRNELLPLSPLSPTMEEEPLVVFLSGEDDPEKIEERKKSKELRSLWRKAIHQQILLLRMEKENQKLEASRDELQSRKVKLDYEEVGACQKEVLITWDKKLLNCRAKIRCDMEDIHTLLKEGVPKSRRGEIWQFLALQYRLRHRLPNKQQPPDISYKELLKQLTAQQHAILVDLGRTFPTHPYFSVQLGPGQLSLFNLLKAYSLLDKEVGYCQGISFVAGVLLLHMSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 66574 - protein, 1298 aa, Homo sapiens
MEPPSCIQDEPFPHPLEPEPGVSAQPGPGKPSDKRFRLWYVGGSCLDHRTTLPMLPWLMAEIRRRSQKPEAGGCGAPAAREVILVLSAPFLRCVPAPGAGASGGTSPSATQPNPAVFIFEHKAQHISRFIHNSHDLTYFAYLIKAQPDDPESQMACHVFRATDPSQVPDVISSIRQLSKAAMKEDAKPSKDNEDAFYNSQKFEVLYCGKVTVTHKKAPSSLIDDCMEKFSLHEQQRLKIQGEQRGPDPGEDLADLEVVVPGSPGDCLPEEADGTDTHLGLPAGASQPALTSSRVCFPERILEDSGFDEQQEFRSRCSSVTGVQRRVHEGSQKSQPRRRHASAPSHVQPSDSEKNRTMLFQVGRFEINLISPDTKSVVLEKNFKDISSCSQGIKHVDHFGFICRESPEPGLSQYICYVFQCASESLVDEVMLTLKQAFSTAAALQSAKTQIKLCEACPMHSLHKLCERIEGLYPPRAKLVIQRHLSSLTDNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSNLSSVRRMYKESNSSSSLPSLHTSFSAPSFTAPSFLKSFYQNSGRLSPQYENEIRQDTASESSDGEGRKRTSSTCSNESLSVGGTSVTPRRISWRQRIFLRVASPMNKSPSAMQQQDGLDRNELLPLSPLSPTMEEEPLVVFLSGEDDPEKIEERKKSKELRSLWRKAIHQQILLLRMEKENQKLEASRDELQSRKVKLDYEEVGACQKEVLITWDKKLLNCRAKIRCDMEDIHTLLKEGVPKSRRGEIWQFLALQYRLRHRLPNKQQPPDISYKELLKQLTAQQHAILVDLGRTFPTHPYFSVQLGPGQLSLFNLLKAYSLLDKEVGYCQGISFVAGVLLLHMSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 66575 - protein, 282 aa, Homo sapiens
DNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSDGEGRKRTSSTCSNESLSVGGTSVTPRRISWRQRIFLRVASPMNKSPSAMQQQDGLDRNELLPLSPLSPTMEEEPLVVFLSGEDDPEKIEER

SEQ ID NO: 66576 - protein, 462 aa, Homo sapiens
MNKSPSAMQQQDGLDRNELLPLSPLSPTMEEEPLVVFLSGEDDPEKIEERKKSKELRSLWRKAIHQQILLLRMEKENQKLEGVPKSRRGEIWQFLALQYRLRHRLPNKQQPPDISYKELLKQLTAQQHAILVDLGRTFPTHPYFSVQLGPGQLSLFNLLKAYSLLDKEVGYCQGISFVAGVLLLHMSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 66577 - protein, 1290 aa, Homo sapiens
MEPPSCIQDEPFPHPLEPEPGVSAQPGPGKPSDKRFRLWYVGGSCLDHRTTLPMLPWLMAEIRRRSQKPEAGGCGAPAAREVILVLSAPFLRCVPAPGAGASGGTSPSATQPNPAVFIFEHKAQHISRFIHNSHDLTYFAYLIKAQPDDPESQMACHVFRATDPSQVPDVISSIRQLSKAAMKEDAKPSKDNEDAFYNSQKFEVLYCGKVTVTHKKAPSSLIDDCMEKFSLHEQQRLKIQGEQRGPDPGEDLADLEVVVPGSPGDCLPEEADGTDTHLGLPAGASQPALTSSRVCFPERILEDSGFDEQQEFRSRCSSVTGVQRRVHEGSQKSQPRRRHASAPSHVQPSDSEKNRTMLFQVGRFEINLISPDTKSVVLEKNFKDISSCSQGIKHVDHFGFICRESPEPGLSQYICYVFQCASESLVDEVMLTLKQAFSTAAALQSAKTQIKLCEACPMHSLHKLCERIEGLYPPRAKLVIQRHLSSLTDNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSNLSSVRRMYKESNSSSSLPSLHTSFSAPSFTAPSFLKSFYQNSGRLSPQYENEISDGEGRKRTSSTCSNESLSVGGTSVTPRRISWRQRIFLRVASPMNKSPSAMQQQDGLDRNELLPLSPLSPTMEEEPLVVFLSGEDDPEKIEERKKSKELRSLWRKAIHQQILLLRMEKENQKLEASRDELQSRKVKLDYEEVGACQKEVLITWDKKLLNCRAKIRCDMEDIHTLLKEGVPKSRRGEIWQFLALQYRLRHRLPNKQQPPDISYKELLKQLTAQQHAILVDLGRTFPTHPYFSVQLGPGQLSLFNLLKAYSLLDKEVGYCQGISFVAGVLLLHMSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 66578 - protein, 398 aa, Homo sapiens
MHFSTVTRDMEAFTASSLSSLGAAGGFPGAASPGADPYGPREPPPPPPRYDPCAAAAPGAPGPPPPPHAYPFAPAAGAATSAAAEPEGPGASCAAAAKAPVKKNAKVAGVSVQLEMKALWDEFNQLGTEMIVTKAGRRMFPTFQVKLFGMDPMADYMLLMDFVPVDDKRYRYAFHSSSWLVAGKADPATPGRVHYHPDSPAKGAQWMKQIVSFDKLKLTNNLLDDNGHIILNSMHRYQPRFHVVYVDPRKDSEKYAEENFKTFVFEETRFTAVTAYQNHRITQLKIASNPFAKGFRDCDPEDWPRNHRPGALPLMSAFARSRNPVASPTQPSGTEKGGHVLKDKEVKAETSRNTPEREVELLRDAGGCVNLGLPCPAECQPFNTQGLVAGRTAGDRLC

SEQ ID NO: 66579 - protein, 495 aa, Homo sapiens
MHFSTVTRDMEAFTASSLSSLGAAGGFPGAASPGADPYGPREPPPPPPRYDPCAAAAPGAPGPPPPPHAYPFAPAAGAATSAAAEPEGPGASCAAAAKAPVKKNAKVAGVSVQLEMKALWDEFNQLGTEMIVTKAGRRMFPTFQVKLFGMDPMADYMLLMDFVPVDDKRYRYAFHSSSWLVAGKADPATPGRVHYHPDSPAKGAQWMKQIVSFDKLKLTNNLLDDNGHIILNSMHRYQPRFHVVYVDPRKDSEKYAEENFKTFVFEETRFTAVTAYQNHRITQLKIASNPFAKGFRDCDPEDWPRNHRPGALPLMSAFARSRNPVASPTQPSGTEKDAAEARREFQRDAGGPAVLGDPAHPPQLLARVLSPSLPGAGGAGGLVPLPGAPGGRPSPPNPELRLEAPGASEPLHHHPYKYPAAAYDHYLGAKSRPAPYPLPGLRGHGYHPHAHPHHHHHPVSPAAAAAAAAAAAAAAANMYSSAGAAPPGSYDYCPR

SEQ ID NO: 66580 - protein, 372 aa, Homo sapiens
MHFSTVTRDMEAFTASSLSSLGAAGGFPGAASPGADPYGPREPPPPPPRYDPCAAAAPGAPGPPPPPHAYPFAPAAGAATSAAAEPEGPGASCAAAAKAPVKKNAKVAGVSVQLEMKALWDEFNQLGTEMIVTKAGRRMFPTFQVKLFGMDPMADYMLLMDFVPVDDKRYRYAFHSSSWLVAGKADPATPGRVHYHPDSPAKGAQWMKQIVSFDKLKLTNNLLDDNGHIILNSMHRYQPRFHVVYVDPRKDSEKYAEENFKTFVFEETRFTAVTAYQNHRITQLKIASNPFAKGFRDCDPEDWPRNHRPGALPLMSAFARSRNPVASPTQPSGTEKGLVTEGSGLQPGLLDVLLKPPSKKSESLRPPHCKDT

SEQ ID NO: 66581 - protein, 385 aa, Homo sapiens
MAAFLSAGLGILAPSETYPLPTTSSGWEPRLGSPFPSGPCTSSTGAQAVAEPTGQGPKNPRVSRVTVQLEMKPLWEEFNQLGTEMIVTKAGRRMFPPFQVKILGMDSLADYALLMDFIPLDDKRYRYAFHSSAWLVAGKADPATPGRVHFHPDSPAKGAQWMRQIVSFDKLKLTNNLLDDNGHIILNSMHRYQPRFHVVFVDPRKDSERYAQENFKSFIFTETQFTAVTAYQNHRITQLKIASNPFAKGFRESDLDSWPVAPRPLLSVPARSHSSLSPCVLKGATDREKDPNKASASTSKTPAWLHHQLLPPPEVLLAPATYRPVTYQSLYSGAPSHLGIPRTRPAPYPLPNIRADRDQGGLPLPAGLGLLSPTVVCLGPGQDSQ

SEQ ID NO: 66582 - protein, 496 aa, Homo sapiens
MSSMEEIQVELQCADLWKRFHDIGTEMIITKAGRRMFPAMRVKITGLDPHQQYYIAMDIVPVDNKRYRYVYHSSKWMVAGNADSPVPPRVYIHPDSLASGDTWMRQVVSFDKLKLTNNELDDQGHIILHSMHKYQPRVHVIRKDFSSDLSPTKPVPVGDGVKTFNFPETVFTTVTAYQNQQITRLKIDRNPFAKGFRDSGRNRTGLEAIMETYAFWRPPVRTLTFEDFTTMQKQQGGSTGTSPTTSSTGTPSPSASSHLLSPSCSPPTFHLAPNTFNVGCRESQLCNLNLSDYPPCARSNMAALQSYPGLSDSGYNRLQSGTTSATQPSETFMPQRTPSLISGIPTPPSLPGNSKMEAYGGQLGSFPTSQFQYVMQAGNAASSSSSPHMFGGSHMQQSSYNAFSLHNPYNLYGYNFPTSPRLAASPEKLSASQSTLLCSSPSNGAFGERQYLPSGMEHSMHMISPSPNNQQATNTCDGRQYGAVPGSSSQMSVHMV

SEQ ID NO: 66583 - protein, 399 aa, Homo sapiens
MHKYQPRVHVIRKDFSSDLSPTKPVPVGDGVKTFNFPETVFTTVTAYQNQQITRLKIDRNPFAKGFRDSGRNRTGLEAIMETYAFWRPPVRTLTFEDFTTMQKQQASKKTSQGYTVNQHSSETDAIELYERRVWLMERRGSTGTSPTTSSTGTPSPSASSHLLSPSCSPPTFHLAPNTFNVGCRESQLCNLNLSDYPPCARSNMAALQSYPGLSDSGYNRLQSGTTSATQPSETFMPQRTPSLISGIPTPPSLPGNSKMEAYGGQLGSFPTSQFQYVMQAGNAASSSSSPHMFGGSHMQQSSYNAFSLHNPYNLYGYNFPTSPRLAASPEKLSASQSTLLCSSPSNGAFGERQYLPSGMEHSMHMISPSPNNQQATNTCDGRQYGAVPGSSSQMSVHMV

SEQ ID NO: 66584 - protein, 602 aa, Homo sapiens
MSERRRSAVALSSRAHAFSVEALIGSNKKRKLRDWEEKGLDLSMEALSPAGPLGDTEDAAAHGLEPHPDSEQSTGSDSEVLTERTSCSFSTHTDLASGAAGPVPAAMSSMEEIQVELQCADLWKRFHDIGTEMIITKAGRRMFPAMRVKITGLDPHQQYYIAMDIVPVDNKRYRYVYHSSKWMVAGNADSPVPPRVYIHPDSLASGDTWMRQVVSFDKLKLTNNELDDQGHIILHSMHKYQPRVHVIRKDFSSDLSPTKPVPVGDGVKTFNFPETVFTTVTAYQNQQITRLKIDRNPFAKGFRDSGRNRTGLEAIMETYAFWRPPVRTLTFEDFTTMQKQQGGSTGTSPTTSSTGTPSPSASSHLLSPSCSPPTFHLAPNTFNVGCRESQLCNLNLSDYPPCARSNMAALQSYPGLSDSGYNRLQSGTTSATQPSETFMPQRTPSLISGIPTPPSLPGNSKMEAYGGQLGSFPTSQFQYVMQAGNAASSSSSPHMFGGSHMQQSSYNAFSLHNPYNLYGYNFPTSPRLAASPEKLSASQSTLLCSSPSNGAFGERQYLPSGMEHSMHMISPSPNNQQATNTCDGRQYGAVPGSSSQMSVHMV

SEQ ID NO: 66585 - protein, 253 aa, Homo sapiens
RVRTGLEAIMETYAFWRPPVRTLTFEDFTTMQKQQASKKTSQGYTVNQHSSETDAIELYERRVWLMERRGSTGTSPTTSSTGTPSPSASSHLLSPSCSPPTFHLAPNTFNVGCRESQLCNLNLSDYPPCARSNMAALQSYPGLSDSGYNRLQSGTTSATQPSETFMPQRTPSLISGIPTPPSLPTARWKPTVASWGPFPLPSFSMSCRQAMLPPAPHHHTCSGAATCSRAPTMPSPFTTLTTCMDTISPLPLG

SEQ ID NO: 66586 - protein, 330 aa, Homo sapiens
GRNRTGLEAIMETYAFWRPPVRTLTFEDFTTMQKQQASKKTSQGYTVNQHSSETDAIELYERRVWLMERRGSTGTSPTTSSTGTPSPSASSHLLSPSCSPPTFHLAPNTFNVGCRESQLCNLNLSDYPPCARSNMAALQSYPGLSDSGYNRLQSGTTSATQPSETFMPQRTPSLISGIPTPPSLPGNSKMEAYGGQLGSFPTSQFQYVMQAGNAASSSSSPHMFGGSHMQQSSYNAFSLHNPYNLYGYNFPTSPRLAASPEKLSASQSTLLCSSPSNGAFGERQYLPSGMEHSMHMISPSPNNQQATNTCDGRQYGAVPGSSSQMSVHMV

SEQ ID NO: 66587 - protein, 448 aa, Homo sapiens
MAMSELGTRKPSDGTVSHLLNVVESELQAGREKGDPTEKQLQIILEDAPLWQRFKEVTNEMIVTKNGRRMFPVLKISVTGLDPNAMYSLLLDFVPTDSHRWKYVNGEWVPAGKPEVSSHSCVYIHPDSPNFGAHWMKAPISFSKVKLTNKLNGGGQIMLNSLHKYEPQVHIVRVGSAHRMVTNCSFPETQFIAVTAYQNEEITALKIKYNPFAKAFLDAKERNHLRDVPEAISESQHVTYSHLGGWIFSNPDGVCTAGNSNYQYAAPLPLPAPHTHHGCEHYSGLRGHRQAPYPSAYMHRNHSPSVNLIESSSNNLQVFSGPDSWTSLSSTPHASILSVPHTNGPINPGPSPYPCLWTISNGAGGPSGPGPEVHASTPGAFLLGNPAVTSPPSVLSTQAPTSAGVEVLGEPSLTSIAVSTWTAVASHPFAGWGGPGAGGHHSPSSLDG

SEQ ID NO: 66588 - protein, 325 aa, Homo sapiens
MIVTKNGRRMFPVLKISVTGLDPNAMYSLLLDFVPTDSHRWKYVNGEWVPAGKPEVSSHSCVYIHPDSPNFGAHWMKAPISFSKVKLTNKLNGGGQIMLNSLHKYEPQVHIVRVGSAHRMVTNCSFPETQFIAVTAYQNEEITALKIKYNPFAKAFLDAKERNHLRDVPEAISESQHVTYSHLNLIESSSNNLQVFSGPDSWTSLSSTPHASILSVPHTNGPINPGPSPYPCLWTISNGAGGPSGPGPEVHASTPGAFLLGNPAVTSPPSVLSTQAPTSAGVEVLGEPSLTSIAVSTWTAVASHPFAGWGGPGAGGHHSPSSLDG

SEQ ID NO: 66589 - protein, 318 aa, Homo sapiens
  MOD_RES (1)..(1): Any amino acid
XRMFPVLKISVTGLDPNAMYSLLLDFVPTDSHRWKYVNGEWVPAGKPEVSSHSCVYIHPDSPNFGAHWMKAPISFSKVKLTNKLNGGGQIMLNSLHKYEPQVHIVRVGSAHRMVTNCSFPETQFIAVTAYQNEEITALKIKYNPFAKAFLDAKERNHLRDVPEAISESQHVTYSHLNLIESSSNNLQVFSGPDSWTSLSSTPHASILSVPHTNGPINPGPSPYPCLWTISNGAGGPSGPGPEVHASTPGAFLLGNPAVTSPPSVLSTQAPTSAGVEVLGEPSLTSIAVSTWTAVASHPFAGWGGPGAGGHHSPSSLDG

SEQ ID NO: 66590 - protein, 281 aa, Homo sapiens
  MOD_RES (1)..(1): Any amino acid
XKERELNWFYRRQRVLFAHVYPTFTNTSCLCKCKITALKIKYNPFAKAFLDAKERNHLRDVPEAISESQHVTYSHLGGWIFSNPDGVCTAGNSNYQYAAPLPLPAPHTHHGCEHYSGLRGHRQAPYPSAYMHRNHSPSVNLIESSSNNLQVFSGPDSWTSLSSTPHASILSVPHTNGPINPGPSPYPCLWTISNGAGGPSGPGPEVHASTPGAFLLGNPAVTSPPSVLSTQAPTSAGVEVLGEPSLTSIAVSTWTAVASHPFAGWGGPGAGGHHSPSSLDG

SEQ ID NO: 66591 - protein, 447 aa, Homo sapiens
MEFTASPKPQLSSRANAFSIAALMSSGGSKEKEATENTIKPLEQFVEKSSCAQPLGELTSLDAHGEFGGGSGSSPSSSSLCTEPLIPTTPIIPSEEMAKIACSLETKELWDKFHELGTEMIITKSGRRMFPTIRVSFSGVDPEAKYIVLMDIVPVDNKRYRYAYHRSSWLVAGKADPPLPARLYVHPDSPFTGEQLLKQMVSFEKVKLTNNELDQHGHIILNSMHKYQPRVHIIKKKDHTASLLNLKSEEFRTFIFPETVFTAVTAYQNQLITKLKIDSNPFAKGFRDSSRLTDIERESVESLIQKHSYARSPIRTYGGEEDVLGDESQTTPNRGSAFTTSDNLSLSSWVSSSSSFPGFQHPQSLTALGTSTASIATPIPHPIQGSLPPYSRLGMPLTPSAIASSMQGSGPTFPSFHMPRYHHYFQQGPYAAIQGLRHSSAVMTPFV

SEQ ID NO: 66592 - protein, 535 aa, Homo sapiens
MGIVEPGCGDMLTGTEPMPGSDEGRAPGADPQHRYFYPEPGAQDADERRGGGSLGSPYPGGALVPAPPSRFLGAYAYPPRPQAAGFPGAGESFPPPADAEGYQPGEGYAAPDPRAGLYPGPREDYALPAGLEVSGKLRVALNNHLLWSKFNQHQTEMIITKQGRRMFPFLSFTVAGLEPTSHYRMFVDVVLVDQHHWRYQSGKWVQCGKAEGSMPGNRLYVHPDSPNTGAHWMRQEVSFGKLKLTNNKGASNNVTQMIVLQSLHKYQPRLHIVEVNDGEPEAACNASNTHIFTFQETQFIAVTAYQNAEITQLKIDNNPFAKGFRENFESMYTSVDTSIPSPPGPNCQFLGGDHYSPLLPNQYPVPSRFYPDLPGQAKDVVPQAYWLGAPRDHSYEAEFRAVSMKPAFLPSAPGPTMSYYRGQEVLAPGAGWPVAPQYPPKMGPASWFRPMRTLPMEPGPGGSEGRGPEDQGPPLVWTEIAPIRPESSDSGLGEGDSKRRRVSPYPSSGDSSSPAGAPSPFDKEAEGQFYNYFPN

SEQ ID NO: 66593 - protein, 400 aa, Homo sapiens
MFPSVRVKVKGLDPGKQYHVAIDVVPVDSKRYRYVYHSSQWMVAGNTDHLCIIPRFYVHPDSPCSGETWMRQIISFDRMKLTNNEMDDKGHIILQSMHKYKPRVHVIEQGSSVDLSQIQSLPTEGVKTFSFKETEFTTVTAYQNQQITKLKIERNPFAKGFRDTGRNRGVLDGLLETYPWRPSFTLDFKTFGADTQSGSSGSSPVTSSGGAPSPLNSLLSPLCFSPMFHLPTSSLGMPCPEAYLPNVNLPLCYKICPTNFWQQQPLVLPAPERLASSNSSQSLAPLMMEVPMLSSLGVTNSKSGSSEDSSDQYLQAPNSTNQMLYGLQSPGNIFLPNSITPEALSCSFHPSYDFYRYNFSMPSRLISGSNHLKVNDDSQVSFGEGKCNHVHWYPAINHYL

SEQ ID NO: 66594 - protein, 520 aa, Homo sapiens
MALSSRARAFSVEALVGRPSKRKLQDPIQAEQPELREKKGGEEEEERRSSAAGKSEPLEKQPKTEPSTSASSGCGSDSGYGNSSESLEEKDIQMELQGSELWKRFHDIGTEMIITKAGRRMFPSVRVKVKGLDPGKQYHVAIDVVPVDSKRYRYVYHSSQWMVAGNTDHLCIIPRFYVHPDSPCSGETWMRQIISFDRMKLTNNEMDDKGHIILQSMHKYKPRVHVIEQGSSVDLSQIQSLPTEGVKTFSFKETEFTTVTAYQNQQITKLKIERNPFAKGFRDTGRNRGVLDGLLETYPWRPSFTLDFKTFGADTQSGSSGSSPVTSSGGAPSPLNSLLSPLCFSPMFHLPTSSLGMPCPEAYLPNVNLPLCYKICPTNFWQQQPLVLPAPERLASSNSSQSLAPLMMEVPMLSSLGVTNSKSGSSEDSSDQYLQAPNSTNQMLYGLQSPGNIFLPNSITPEALSCSFHPSYDFYRYNFSMPSRLISGSNHLKVNDDSQVSFGEGKCNHVHWYPAINHYL

SEQ ID NO: 66595 - protein, 520 aa, Homo sapiens; identical to SEQ ID NO: 66594

SEQ ID NO: 66596 - protein, 400 aa, Homo sapiens; identical to SEQ ID NO: 66593

SEQ ID NO: 66597 - protein, 743 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTLAFPSDHATWQGNYSFGTQTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 66598 - protein, 723 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 66599 - protein, 600 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTLAFPSDHATWQGNYSFGTQTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAAASSSVHRHPFLNLNTMRPRLRYSPYSIPVPVPDGSSLLTTALAASPASVAVDSGSELNSRSSTLSSSSMSLSPKLCAEKEAATSELQSIQRLVSGLEAKPDRSRSASP

SEQ ID NO: 66600 - protein, 545 aa, Homo sapiens
MLQDKGLSESEEAFRAPGPALGEASAANAPEPALAAPGLSGAALGSPPGPGADVVAAAAAEQTIENIKVGLHEKELWKKFHEAGTEMIITKAGRRMFPSYKVKVTGMNPKTKYILLIDIVPADDHRYKFCDNKWMVAGKAEPAMPGRLYVHPDSPATGAHWMRQLVSFQKLKLTNNHLDPFGHIILNSMHKYQPRLHIVKADENNAFGSKNTAFCTHVFPETSFISVTSYQNHKITQLKIENNPFAKGFRGSDDSDLRVARLQSKEYPVISKSIMRQRLISPQLSATPDVGPLLGTHQALQHYQHENGAHSQLAEPQDLPLSTFPTQRDSSLFYHCLKRRDGTRHLDLPCKRSYLEAPSSVGEDHYFRSPPPYDQQMLSPSYCSEVTPREACMYSGSGPEIAGVSGVDDLPPPPLSCNMWTSVSPYTSYSVQTMETVPYQPFPTHFTATTMMPRLPTLSAQSSQPPGNAHFSVYNQLSQSQVRERGPSASFPRERGLPQGCERKPPSPHLNAANEFLYSQTFSLSRESSLQYHSGMGTVENWTDG

SEQ ID NO: 66601 - protein, 546 aa, Homo sapiens
MLQDKGLSESEEAFRAPGPALGEASAANAPEPALAAPGLSGAALGSPPGPGADVVAAAAAEQTIENIKVGLHEKELWKKFHEAGTEMIITKAGRRMFPSYKVKVTGMNPKTKYILLIDIVPADDHRYKFCDNKWMVAGKAEPAMPGRLYVHPDSPATGAHWMRQLVSFQKLKLTNNHLDPFGHIILNSMHKYQPRLHIVKADENNAFGSKNTAFCTHVFPETSFISVTSYQNHKITQLKIENNPFAKGFRGSDDSDLRVARLQSKEYPVISKSIMRQRLISPQLSATPDVGPLLGTHQALQHYQHENGAHSQLAEPQDLPLSTFPTQRDSSLFYHCLKRRADGTRHLDLPCKRSYLEAPSSVGEDHYFRSPPPYDQQMLSPSYCSEVTPREACMYSGSGPEIAGVSGVDDLPPPPLSCNMWTSVSPYTSYSVQTMETVPYQPFPTHFTATTMMPRLPTLSAQSSQPPGNAHFSVYNQLSQSQVRERGPSASFPRERGLPQGCERKPPSPHLNAANEFLYSQTFSLSRESSLQYHSGMGTVENWTDG

SEQ ID NO: 66602 - protein, 518 aa, Homo sapiens
MADADEGFGLAHTPLEPDAKDLPCDSKPESALGAPSKSPSSPQAAFTQQGMEGIKVFLHERELWLKFHEVGTEMIITKAGRRMFPSYKVKVTGLNPKTKYILLMDIVPADDHRYKFADNKWSVTGKAEPAMPGRLYVHPDSPATGAHWMRQLVSFQKLKLTNNHLDPFGHIILNSMHKYQPRLHIVKADENNGFGSKNTAFCTHVFPETAFIAVTSYQNHKITQLKIENNPFAKGFRGSDDMELHRMSRMQSKEYPVVPRSTVRQKVASNHSPFSSESRALSTSSNLGSQYQCENGVSGPSQDLLPPPNPYPLPQEHSQIYHCTKRKEEECSTTDHPYKKPYMETSPSEEDSFYRSSYPQQQGLGASYRTESAQRQACMYASSAPPSEPVPSLEDISCNTWPSMPSYSSCTVTTVQPMDRLPYQHFSAHFTSGPLVPRLAGMANHGSPQLGEGMFQHQTSVAHQPVVRQCGPQTGLQSPGTLQPPEFLYSHGVPRTLSPHQYHSVHGVGMVPEWSDNS

SEQ ID NO: 66603 - protein, 468 aa, Homo sapiens
MEGIKVFLHERELWLKFHEVGTEMIITKAGRRMFPSYKVKVTGLNPKTKYILLMDIVPADDHRYKFADNKWSVTGKAEPAMPGRLYVHPDSPATGAHWMRQLVSFQKLKLTNNHLDPFGHIILNSMHKYQPRLHIVKADENNGFGSKNTAFCTHVFPETAFIAVTSYQNHKITQLKIENNPFAKGFRGSDDMELHRMSRMQSKEYPVVPRSTVRQKVASNHSPFSSESRALSTSSNLGSQYQCENGVSGPSQDLLPPPNPYPLPQEHSQIYHCTKRKEEECSTTDHPYKKPYMETSPSEEDSFYRSSYPQQQGLGASYRTESAQRQACMYASSAPPSEPVPSLEDISCNTWPSMPSYSSCTVTTVQPMDRLPYQHFSAHFTSGPLVPRLAGMANHGSPQLGEGMFQHQTSVAHQPVVRQCGPQTGLQSPGTLQPPEFLYSHGVPRTLSPHQYHSVHGVGMVPEWSDNS

SEQ ID NO: 66604 - protein, 518 aa, Homo sapiens; identical to SEQ ID NO: 66602

SEQ ID NO: 66605 - protein, 422 aa, Homo sapiens
MDIVPADDHRYKFADNKWSVTGKAEPAMPGRLYVHPDSPATGAHWMRQLVSFQKLKLTNNHLDPFGHIILNSMHKYQPRLHIVKADENNGFGSKNTAFCTHVFPETAFIAVTSYQNHKITQLKIENNPFAKGFRGSDDMELHRMSRMQSKEYPVVPRSTVRQKVASNHSPFSSESRALSTSSNLGSQYQCENGVSGPSQDLLPPPNPYPLPQEHSQIYHCTKRKEEECSTTDHPYKKPYMETSPSEEDSFYRSSYPQQQGLGASYRTESAQRQACMYASSAPPSEPVPSLEDISCNTWPSMPSYSSCTVTTVQPMDRLPYQHFSAHFTSGPLVPRLAGMANHGSPQLGEGMFQHQTSVAHQPVVRQCGPQTGLLHNRHFLEKERERGERERRRETVAKRTPRTRFFISPNVHICTQGRWMLI

SEQ ID NO: 66606 - protein, 349 aa, Homo sapiens
MADADEGFGLAHTPLEPDAKDLPCDSKPESALGAPSKSPSSPQAAFTQQGMEGIKVFLHERELWLKFHEVGTEMIITKAGRRMFPSYKVKVTGLNPKTKYILLMDIVPADDHRYKFADNKWSVTGKAEPAMPGRLYVHPDSPATGAHWMRQLVSFQKLKLTNNHLDPFGHIILNSMHKYQPRLHIVKADENNGFGSKNTAFCTHVFPETAFIAVTSYQNHKITQLKIENNPFAKGFRGSDDMELHRMSRMQSKEYPVVPRSTVRQKVASNHSPFSSESRALSTSSNLGSQYQCENGVSGPSQDLLPPPNPYPLPQEHSQIYHCTKRKGECDHPWSICFLSYLFLSLGWG

SEQ ID NO: 66607 - protein, 436 aa, Homo sapiens
MYHPRELYPSLGAGYRLGPAQPGADSSFPPALAEGYRYPELDTPKLDCFLSGMEAAPRTLAAHPPLPLLPPAMGTEPAPSAPEALHSLPGVSLSLENRELWKEFSSVGTEMIITKAGRRMFPACRVSVTGLDPEARYLFLLDVIPVDGARYRWQGRRWEPSGKAEPRLPDRVYIHPDSPATGAHWMRQPVSFHRVKLTNSTLDPHGHLILHSMHKYQPRIHLVRAAQLCSQHWGGMASFRFPETTFISVTAYQNPQITQLKIAANPFAKGFRENGRNCKRERDARVKRKLRGPEPAATEAYGSGDTPGGPCDSTLGGDIRESDPEQAPAPGEATAAPAPLCGGPSAEAYLLHPAAFHGAPSHLPTRSPSFPEAPDSGRSAPYSAAFLELPHGSGGSGYPAAPPAVPFAPHFLQGGPFPLPYTAPGGYLDVGSKPMY

SEQ ID NO: 66608 - protein, 436 aa, Homo sapiens; identical to SEQ ID NO: 66607

SEQ ID NO: 66609 - protein, 295 aa, Homo sapiens
MYHPRELYPSLGAGYRLGPAQPGADSSFPPALAEGYRYPELDTPKLDCFLSGMEAAPRTLAAHPPLPLLPPAMGTEPAPSAPEALHSLPGVSLSLENRELWKEFSSVGTEMIITKAGRRMFPACRVSVTGLDPEARYLFLLDVIPVDGARYRWQGRRWEPSGKAEPRLPDRVYIHPDSPATGAHWMRQPVSFHRVKLTNSTLDPHGHLILHSMHKYQPRIHLVRAAQLCSQHWGGMASFRFPETTFISVTAYQNPQITQLKIAANPFAKGFRENGRNCKRWELFIHLFMHSTNVY

SEQ ID NO: 66610 - protein, 657 aa, Homo sapiens
MEMETTEPEPDCVVQPPSPPDDFSCQMRLSEKITPLKTCFKKKDQKRLGTGTLRSLRPILNTLLESGSLDGVFRSRNQSTDENSLHEPMMKKAMEINSSCPPAENNMSVLIPDRTNVGDQIPEAHPSTEAPERVVPIQDHSFPSETLSGTVADSTPAHFQTDLLHPVSSDVPTSPDCLDKVIDYVPGIFQENSFTIQYILDTSDKLSTELFQDKSEEASLDLVFELVNQLQYHTHQENGIEICMDFLQGTCIYGRDCLKHHTVLPYHWQIKRTTTQKWQSVFNDSQEHLERFYCNPENDRMRMKYGGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQTLGGVPTQAPPPLEATSSSQIICPDGVTSANFYPETWVYMHPSQDFIQVPVSAEDKSYRIIYNLFHKTVPEFKYRILQILRVQNQFLWEKYKRKKEYMNRKMFGRDRIINERHLFHGTSQDVVDGICKHNFDPRVCGKHATMFGQGSYFAKKASYSHNFSKKSSKGVHFMFLAKVLTGRYTMGSHGMRRPPPVNPGSVTSDLYDSCVDNFFEPQIFVIFNDDQSYPYFVIQYEEVSNTVSI

SEQ ID NO: 66611 - protein, 657 aa, Homo sapiens; identical to SEQ ID NO: 66610

SEQ ID NO: 66612 - protein, 506 aa, Homo sapiens
MEMETTEPEPDCVVQPPSPPDDFSCQMRLSEKITPLKTCFKKKDQKRLGTGTLRSLRPILNTLLESGSLDGVFRSRNQSTDENSLHEPMMKKAMEINSSCPPAENNMSVLIPDRTNVGDQIPEAHPSTEAPERVVPIQDHSFPSETLSGTVADSTPAHFQTDLLHPVSSDVPTSPDCLDKVIDYVPGIFQENSFTIQYILDTSDKLSTELFQDKSEEASLDLVFELVNQLQYHTHQENGIEICMDFLQGTCIYGRDCLKHHTVLPYHWQIKRTTTQKWQSVFNDSQEHLERFYCNPENDRMRMKYGGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQTLGGVPTQAPPPLEATSSSQIICPDGVTSANFYPETWVYMHPSQDFIQVPVSAEDKSYRIIYNLFHKTVPEFKYRILQILRVQNQFLWEK

SEQ ID NO: 66613 - protein, 654 aa, Homo sapiens
MEMETTEPEPDCVVQPPSPPDDFSCQMRLSEKITPLKTCFKKKDQKRLGTGTLRSLRPILNTLLESGSLDGVFRSRNQSTDENSLHEPMMKKAMEINSSCPPAENNMSVLIPDRTNVGDQIPEAHPSTEAPERVVPIQDHSFPSETLSGTVADSTPAHFQTDLLHPVSSDVPTSPDCLDKVIDYVPGIFQENSFTIQYILDTSDKLSTELFQDKSEEASLDLVFELVNQLQYHTHQENGIEICMDFLQGTCIYGRDCLKHHTVLPYHWQIKRTTTQKWQSVFNDSQEHLERFYCNPENDRMRMKYGGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQTLGGVPTQAPPPLEATSSSQIICPDGVTSANFYPETWVYMHPSQDFIQVPVSAEDKSYRIIYNLFHKTVPEFKYRILQILRVQNQFLWEKYKRKKEYMNRKMFGRDRIINERHLFHGTSQDVVDGICKHNFDPRVCGKHATMFGQGSYFAKKASYSHNFSKKSSKGVHFMFLAKVLTGRYTMGSHGMRRPPPVNPGSVTSDLYDSCVDNFFEPQIFVIFNDDQSYPYFVIQYEEVSNT

SEQ ID NO: 66614 - protein, 657 aa, Homo sapiens; identical to SEQ ID NO: 66610

SEQ ID NO: 66615 - protein, 657 aa, Homo sapiens; identical to SEQ ID NO: 66610

SEQ ID NO: 66616 - protein, 553 aa, Homo sapiens
MGALEMQDEEDRIEALKQVADKLPRPNLLLLKHLVYVLHLISKNSEVNRMDSSNLAICIGPNMLTLENDQSLSFEAQKDLNNKVKTLVEFLIDNCFEIFGENIPVHSSITSDDSLEHTDSSDVSTLQNDSAYDSNDPDVESNSSSGISSPSRQPQVPMATAAGLDSAGPQDAREVSPEPIVSTVARLKSSLAQPDRRYSEPSMPSSQECLESRVTNQTLTKSEGDFPVPRVGSRLESEEAEDPFPEEVFPAVQGKTKRPVDLKIKNLAPGSVLPRALVLKAFSSSSLDASSDSSPVASPSSPKRNFFSRHQSFTTKTEKGKPSREIKKHSMSFTFAPHKKVLTKNLSAGSGKSQDFTRDHVPRGVRKESQLAGRIVQENGCETHNQTARGFCLRPHALSVDDVFQGADWERPGSPPSYEEAMQGPAARLVASESQTVGSMTVGSMRARMLEAHCLLPPLPPAHHVEDSRHRGSKEPLPGHGLSPLPERWKQSRTVHASGDSLGHVSGPGRPELLPLRTVSESVQRNKRDCLVRRCSQPVFEADQFQYAKESYI

SEQ ID NO: 66617 - protein, 266 aa, Homo sapiens
MKLRSSHNASKTLNANNMETLIECQSEGDIKEHPLLASCESEDSICQLIEVKKRKKVLSWPFLMRRLSPASDFSGALETDLKASLFDQPLSIICGDSDTLPRPIQDILTILCLKGPSTEGIFRRAANEKARKELKEELNSGDAVDLERLPVHLLAVVFKDFLRSIPRKLLSSDLFEEWMGALEMQDEEDRIEALKQVADKLPRPNLLLLKHLVYVLHLISKNSEVNRMDSSNLAICIGPNMLTLENDQSLSFEAQKDLNNKVCSAY

SEQ ID NO: 66618 - protein, 731 aa, Homo sapiens
MKLRSSHNASKTLNANNMETLIECQSEGDIKEHPLLASCESEDSICQLIEVKKRKKVLSWPFLMRRLSPASDFSGALETDLKASLFDQPLSIICGDSDTLPRPIQDILTILCLKGPSTEGIFRRAANEKARKELKEELNSGDAVDLERLPVHLLAVVFKDFLRSIPRKLLSSDLFEEWMGALEMQDEEDRIEALKQVADKLPRPNLLLLKHLVYVLHLISKNSEVNRMDSSNLAICIGPNMLTLENDQSLSFEAQKDLNNKVKTLVEFLIDNCFEIFGENIPVHSSITSDDSLEHTDSSDVSTLQNDSAYDSNDPDVESNSSSGISSPSRQPQVPMATAAGLDSAGPQDAREVSPEPIVSTVARLKSSLAQPDRRYSEPSMPSSQECLESRVTNQTLTKSEGDFPVPRVGSRLESEEAEDPFPEEVFPAVQGKTKRPVDLKIKNLAPGSVLPRALVLKAFSSSSLDASSDSSPVASPSSPKRNFFSRHQSFTTKTEKGKPSREIKKHSMSFTFAPHKKVLTKNLSAGSGKSQDFTRDHVPRGVRKESQLAGRIVQENGCETHNQTARGFCLRPHALSVDDVFQGADWERPGSPPSYEEAMQGPAARLVASESQTVGSMTVGSMRARMLEAHCLLPPLPPAHHVEDSRHRGSKEPLPGHGLSPLPERWKQSRTVHASGDSLGHVSGPGRPELLPLRTVSESVQRNKRDCLVRRCSQPVFEADQFQYAKESYI

SEQ ID NO: 66619 - protein, 275 aa, Homo sapiens
MATAAGLDSAGPQDAREVSPEPIVSTVARLKSSLAQPDRRYSEPSMPSSQECLESRVTNQTLTKSEGDFPVPRVGSRLESEEAEDPFPEEVFPAVQGKTKRPVDLKIKNLAPGSVLPRALVLKAFSSSSLDASSDSSPVASPSSPKRNFFSRHQSFTTKTEKGKPSREIKKHSMSFTFAPHKKVLTKNLSAGSGKSQDFTRDHVPRGVRKESQLAGRIVQENGCETHNQTARGFCLRPHALSVDDVFQGADWERPGSPPSYEEAMQGPAARPWGA

SEQ ID NO: 66620 - protein, 108 aa, Homo sapiens
MTRKIFTNTRERWRQQNVNSAFAKLRKLIPTHPPDKKLSKNETLRLAMRYINFLVKVLGEQSLQQTGVAAQGNILGLFPQGPHLPGLEDRTLLENYQVPSPGPSHHIP

SEQ ID NO: 66621 - protein, 284 aa, Homo sapiens
MEPGMLGPHNLPHHEPISFGIDQILSGPETPGGGLGLGRGGQGHGENGAFSGGYHGASGYGPAGSLAPLPGSSGVGPGGVIRVPAHRPLPVPPPAGGAPAVPGPSGLGGAGGLAGLTFPWMDSGRRFAKDRLTAALSPFSGTRRIGHPYQNRTPPKRKKPRTSFSRSQVLELERRFLRQKYLASAERAALAKALRMTDAQVKTWFQNRRTKWRRQTAEEREAERHRAGRLLLHLQQDALPRPLRPPLPPDPLCLHNSSLFALQNLQPWAEDNKVASVSGLASVV

SEQ ID NO: 66622 - protein, 291 aa, Homo sapiens
MEAPASAQTPHPHEPISFGIDQILNSPDQDSAPAPRGPDGASYLGGPPGGRPGATYPSLPASFAGLGAPFEDAGSYSVNLSLAPAGVIRVPAHRPLPGAVPPPLPSALPAMPSVPTVSSLGGLNFPWMESSRRFVKDRFTAAAALTPFTVTRRIGHPYQNRTPPKRKKPRTSFSRVQICELEKRFHRQKYLASAERAALAKSLKMTDAQVKTWFQNRRTKWRRQTAEEREAERQQASRLMLQLQHDAFQKSLNDSIQPDPLCLHNSSLFALQNLQPWEEDSSKVPAVTSLV

SEQ ID NO: 66623 - protein, 103 aa, Homo sapiens
MAESWSGQALQALPATVLGALGSEFLREWEAQDMRVTLFKLLLLWLVLSLLGIQLAWGFYGNTVTGLYHRPGLGGQNGSTPDGSTHFPSWEMAANEPLKTHRE

SEQ ID NO: 66624 - protein, 128 aa, Homo sapiens
MASEASVRLGVPPGRLWIQRPGIYEDEEGRTWVTVVVRFNPSRREWARASQGSRYEPSITVHLWQMAVHTRELLSSGQMPFSQLPAVWQLYPGRKYRAADSSFWEIADHGQIDSMEQLVLTYQPERKD

SEQ ID NO: 66625 - protein, 128 aa, Homo sapiens; identical to SEQ ID NO: 66624

SEQ ID NO: 66626 - protein, 1591 aa, Homo sapiens
MGNAESQHVEHEFYGEKHASLGRKHTSRSLRLSHKTRRTRHASSGKVIHRNSEVSTRSSSTPSIPQSLAENGLEPFSQDGTLEDFGSPIWVDRVDMGLRPVSYTDSSVTPSVDSSIVLTAASVQSMPDTEESRLYGDDATYLAEGGRRQHSYTSNGPTFMETASFKKKRSKSADIWREDSLEFSLSDLSQEHLTSNEEILGSAEEKDCEEARGMETRASPRQLSTCQRANSLGDLYAQKNSGVTANGGPGSKFAGYCRNLVSDIPNLANHKMPPAAAEETPPYSNYNTLPCRKSHCLSEGATNPQISHSNSMQGRRAKTTQDVNAGEGSEFADSGIEGATTDTDLLSRRSNATNSSYSPTTGRAFVGSDSGSSSTGDAARQGVYENFRRELEMSTTNSESLEEAGSAHSDEQSSGTLSSPGQSDILLTAAQGTVRKAGALAVKNFLVHKKNKKVESATRRKWKHYWVSLKGCTLFFYESDGRSGIDHNSIPKHAVWVENSIVQAVPEHPKKDFVFCLSNSLGDAFLFQTTSQTELENWITAIHSACATAVARHHHKEDTLRLLKSEIKKLEQKIDMDEKMKKMGEMQLSSVTDSKKKKTILDQIFVWEQNLEQFQMDLFRFRCYLASLQGGELPNPKRLLAFASRPTKVAMGRLGIFSVSSFHALVAARTGETGVRRRTQAMSRSASKRRSRFSSLWGLDTTSKKKQGRPSINQVFGEGTEAVKKSLEGIFDDIVPDGKREKEVVLPNVHQHNPDCDIWVHEYFTPSWFCLPNNQPALTVVRPGDTARDTLELICKTHQLDHSAHYLRLKFLIENKMQLYVPQPEEDIYELLYKEIEICPKVTQSIHIEKSDTAADTYGFSLSSVEEDGIRRLYVNSVKETGLASKKGLKAGDEILEINNRAADALNSSMLKDFLSQPSLGLLVRTYPELEEGVELLESPPHRVDGPADLGESPLAFLTSNPGHSLCSEQGSSAETAPEETEGPDLESSDETDHSSKSTEQVAAFCRSLHEMNPSDQSPSPQDSTGPQLATMRQLSDADKLRKVICELLETERTYVKDLNCLMERYLKPLQKETFLTQDELDVLFGNLTEMVEFQVEFLKTLEDGVRLVPDLEKLEKVDQFKKVLFSLGGSFLYYADRFKLYSAFCASHTKVPKVLVKAKTDTAFKAFLDAQNPKQQHSSTLESYLIKPIQRILKYPLLLRELFALTDAESEEHYHLDVAIKTMNKVASHINEMQKIHEEFGAVFDQLIAEQTGEKKEVADLSMGDLLLHTTVIWLNPPASLGKWKKEPELAAFVFKTAVVLVYKDGSKQKKKLVGSHRLSIYEDWDPFRFRHMIPTEALQVRALASADAEANAVCEIVHVKSESEGRPERVFHLCCSSPESRKDFLKAVHSILRDKHRRQLLKTESLPSSQQYVPFGGKRLCALKGARPAMSRAVSAPSKSLGRRRRRLARNRFTIDSDAVSASSPEKESQQPPGGGDTDRWVEEQFDLAQYEEQDDIKETDILSDDDEFCESVKGASVDRDLQERLQATSISQRERGRKTLDSHASRMAQLKKQAALSGINGGLESASEEVIWVRREDFAPSRKLNTEI

SEQ ID NO: 66627 - protein, 1071 aa, Homo sapiens
METASFKKKRSKSADIWREDSLEFSLSDLSQEHLTSNEEILGSAEEKDCEEARGMETRASPRQLSTCQRANSLGDLYAQKNSGVTANGGPGSKFAGYCRNLVSDIPNLANHKMPPAAAEETPPYSNYNTLPCRKSHCLSEGATNPQISHSNSMQGRRAKTTQDVNAGEGSEFADSGIEGATTDTDLLSRRSNATNSSYSPTTGRAFVGSDSGSSSTGDAARQGVYENFRRELEMSTTNSESLEEAGSAHSDEQSSGTLSSPGQSDILLTAAQGTVRKAGALAVKNFLVHKKNKKVESATRRKWKHYWVSLKGCTLFFYESDGRSGIDHNSIPKHAVWVENSIVQAVPEHPKKDFVFCLSNSLGDAFLFQTTSQTELENWITAIHSACATAVARHHHKEDTLRLLKSEIKKLEQKIDMDEKMKKMGEMQLSSVTDSKKKKTILDQIFVWEQNLEQFQMDLFRFRCYLASLQGGELPNPKRLLAFASRPTKVAMGRLGIFSVSSFHALVAARTGETGVRRRTQAMSRSASKRRSRFSSLWGLDTTSKKKQGRPSINQVFGEGTEAVKKSLEGIFDDIVPDGKREKEVVLPNVHQHNPDCDIWVHEYFTPSWFCLPNNQPALTVVRPGDTARDTLELICKTHQLDHSAHYLRLKFLIENKMQLYVPQPEEDIYELLYKEIEICPKVTQSIHIEKSDTAADTYGFSLSSVEEDGIRRLYVNSVKETGLASKKGLKAGDEILEINNRAADALNSSMLKDFLSQPSLGLLVRTYPELEEGVELLESPPHRVDGPADLGESPLAFLTSNPGHSLCSEQGSSAETAPEETEGPDLESSDETDHSSKSTEQVAAFCRSLHEMNPSDQSPSPQDSTGPQLATMRQLSDADKLRKVICELLETERTYVKDLNCLMERYLKPLQKETFLTQDELDVLFGNLTEMVEFQVEFLKTLEDGVRLVPDLEKLEKVDQFKKVLFSLGGSFLYYADRFKLYSAFCAHKSSQGPGESQDRHGFQGILGCPEPEAAALIHAGVVPHQAHPEDPQVPTSAQGAVRPDRCGERGALPPGRGHQDHEQGCQSHQ

SEQ ID NO: 66628 - protein, 225 aa, Homo sapiens
MGNAESQHVEHEFYGEKHASLGRKHTSRSLRLSHKTRRTRHASSGKVIHRNSEVSTRSSSTPSIPQSLAENGLEPFSQDGTLEDFGSPIWVDRVDMGLRPVSYTDSSVTPSVDSSIVLTAASVQSMPDTEESRLYGDDATYLAEGGRRQHSYTSNGPTFMETASFKKKRSKSADIWREDSLEFSLSDLSQEHLTSNEEILGSAEEKDCEEARGMETRASPRQLST

SEQ ID NO: 66629 - protein, 1531 aa, Homo sapiens
MGNAESQHVEHEFYGEKHASLGRKHTSRSLRLSHKTRRTRHASSGKVIHRNSEVSTRSSSTPSIPQSLAENGLEPFSQDGTLEDFGSPIWVDRVDMGLRPVSYTDSSVTPSVDSSIVLTAASVQSMPDTEESRLYGDDATYLAEGGRRQHSYTSNGPTFMETASFKKKRSKSADIWREDSLEFSLSDLSQEHLTSNEEILGSAEEKDCEEARGMETRASPRQLSTCQRANSLGDLYAQKNSGVTANGGPGSKFAGYCRNLVSDIPNLANHKMPPAAAEETPPYSNYNTLPCRKSHCLSEGATNPQISHSNSMQGRRAKTTQDVNAGEGSEFADSGIEGATTDTDLLSRRSNATNSSYSPTTGRAFVGSDSGSSSTGDAARQGVYENFRRELEMSTTNSESLEEAGSAHSDEQSSGTLSSPGQSDILLTAAQGTVRKAGALAVKNFLVHKKNKKVESATRRKWKHYWVSLKGCTLFFYESDGRSGIDHNSIPKHAVWVENSIVQAVPEHPKKDFVFCLSNSLGDAFLFQTTSQTELENWITAIHSACATAVARHHHKEDTLRLLKSEIKKLEQKIDMDEKMKKMGEMQLSSVTDSKKKKTILDQIFVWEQNLEQFQMDLFRFRCYLASLQGGELPNPKRLLAFASRPTKVAMGRLGIFSVSSFHALVAARTGETGVRRRTQAMSRSASKRRSRFSSLWGLDTTSKKKQGRPSINQREKEVVLPNVHQHNPDCDIWVHEYFTPSWFCLPNNQPALTVVRPGDTARDTLELICKLYKEIEICPKVTQSIHIEKSDTAADTYGFSLSSVEEDGIRRLYVNSVKETGLASKKGLKAGDEILEINNRAADALNSSMLKDFLSQPSLGLLVRTYPELEEGVELLESPPHRVDGPADLGESPLAFLTSNPGHSLCSEQGSSAETAPEETEGPDLESSDETDHSSKSTEQVAAFCRSLHEMNPSDQSPSPQDSTGPQLATMRQLSDADKLRKVICELLETERTYVKDLNCLMERYLKPLQKETFLTQDELDVLFGNLTEMVEFQVEFLKTLEDGVRLVPDLEKLEKVDQFKKVLFSLGGSFLYYADRFKLYSAFCASHTKVPKVLVKAKTDTAFKAFLDAQNPKQQHSSTLESYLIKPIQRILKYPLLLRELFALTDAESEEHYHLDVAIKTMNKVASHINEMQKIHEEFGAVFDQLIAEQTGEKKEVADLSMGDLLLHTTVIWLNPPASLGKWKKEPELAAFVFKTAVVLVYKDGSKQKKKLVGSHRLSIYEDWDPFRFRHMIPTEALQVRALASADAEANAVCEIVHVKSESEGRPERVFHLCCSSPESRKDFLKAVHSILRDKHRRQLLKTESLPSSQQYVPFGGKRLCALKGARPAMSRAVSAPSKSLGRRRRRLARNRFTIDSDAVSASSPEKESQQPPGGGDTDRWVEEQFDLAQYEEQDDIKETDILSDDDEFCESVKGASVDRDLQERLQATSISQRERGRKTLDSHASRMAQLKKQAALSGINGGLESASEEVIWVRREDFAPSRKLNTEI

SEQ ID NO: 66630 - protein, 830 aa, Homo sapiens
MGSMFRSEEVALVQLFLPTAAAYTCVSRLGELGLVEFRDLNASVSAFQRRFVVDVRRCEELEKTFTFLQEEVRRAGLVLPPPKGRLPAPPPRDLLRIQEETERLAQELRDVRGNQQALRAQLHQLQLHAAVLRQGHEPQLAAAHTDGASERTPLLQAPGGPHQDLRVNFVAGAVEPHKAPALERLLWRACRGFLIASFRELEQPLEHPVTGEPATWMTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 66631 - protein, 218 aa, Homo sapiens
MGSMFRSEEVALVQLFLPTAAAYTCVSRLGELGLVEFRDLNASVSAFQRRFVVDVRRCEELEKTFTFLQEEVRRAGLVLPPPKGRLPAPPPRDLLRIQEETERLAQELRDVRGNQQALRAQLHQLQLHAAVLRQGHEPQLAAAHTDGASERTPLLQAPGGPHQDLRVNFVAGAVEPHKAPALERLLWRACRGFLIASFRELEQPLEHPVTGEPATWMT

SEQ ID NO: 66632 - protein, 61 aa, Homo sapiens
DDEEEAELVPSEVLMHQAIHTIEFCLGCVSNTASYLRLWALSLAHARWNSRTSSTQARATS

SEQ ID NO: 66633 - protein, 614 aa, Homo sapiens
MTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 66634 - protein, 118 aa, Homo sapiens
MVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHARWNSRTSSTQARATS

SEQ ID NO: 66635 - protein, 556 aa, Homo sapiens
MEGPLSVFGDRSTGETIRSQNVMAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 66636 - protein, 401 aa, Homo sapiens
MSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 66637 - protein, 433 aa, Homo sapiens
MEGPLSVFGDRSTGETIRSQNVMAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMDWS

SEQ ID NO: 66638 - protein, 215 aa, Homo sapiens
MLAGQLEARDPKEGTHPEDPCPGAGAVMEKTAVAAEVLTEDCNTGEMPPLQQQIIRLHQELGRQKSLWADVHGKLRSHIDALREQNMELREKLRALQLQRWKARKKSAASPHAGQESHTLALEPAFGKISPLSADEETIPKYAGHKNQSATLLGQRSSSNNSAPPKPMSLKIERISSWKTPPQENRDKNLSRRRQDRRATPTGRPTPCAERRGGV

SEQ ID NO: 66639 - protein, 326 aa, Homo sapiens
MEKTPAAAEVPREDSNAGEMPSLQQQITSLHQELGRQQSLWADIHRKLQSHMDALRKQNRELREELRGLQRQQWEAGKKPAASPHAGRESHTLALEPAFGKISHLSADEDTTPKYAGRKSQSATLLGQRWSSNHLAPPKPMSLKTERINSGKTPPQEDREKSPPGRRQDRSPAPTGRPTPGAERRGVSEDGKIMHPSSRSPQNSGGRKSPVQASQATTLQEQTAAARGADRSSSVLGSSEGGFLSRVQADEFASSAPDSAERQNLPVNPPSSLEIAQAMDTKMKKEEVQEEKRHPKGKADDCRRSGFPSEFPGALHAAPSRQDMGP

SEQ ID NO: 66640 - protein, 441 aa, Homo sapiens
MAPKGILGSFPTAMNLSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 66641 - protein, 516 aa, Homo sapiens
MTRGGGGGDTISKMPDVKESVPPKYPGDSEGRSCKPETSGPPQEDKSGSEDPPPFLSVTGLTETVNEVSKLSNKIGMNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 66642 - protein, 273 aa, Homo sapiens
GLSHRATPQPAAPPRWYAPGRQAARPTERTPVDDPRRGRRSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPE

SEQ ID NO: 66643 - protein, 441 aa, Homo sapiens; identical to SEQ ID NO: 66640

SEQ ID NO: 66644 - protein, 103 aa, Homo sapiens
MAPKGILGSFPTAMNLSLEGKVKETVHNAFWDHLKEQLSATPPDFSCALELLKEIKEILLSLLLPRQNRLRIEIEEALDMDLLKQEAEHGALKVLYLSKYVLN

SEQ ID NO: 66645 - protein, 503 aa, Homo sapiens
MPDVKESVPPKYPGDSEGRSCKPETSGPPQEDKSGSEDPPPFLSVTGLTETVNEVSKLSNKIGMNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 66646 - protein, 470 aa, Homo sapiens
MTRGGGGGVLSVTGLTETVNEVSKLSNKIGMNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 66647 - protein, 465 aa, Homo sapiens
MTRGGGGGGLTETVNEVSKLSNKIGMNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 66648 - protein, 54 aa, Homo sapiens
MTRGGGGGDTISKMPDVKESVPPKYPGDSEGRSCKPETSGPPQEDKSGSEDPPP

SEQ ID NO: 66649 - protein, 54 aa, Homo sapiens; identical to SEQ ID NO: 66648

SEQ ID NO: 66650 - protein, 198 aa, Homo sapiens
MFFERHLENLLKHFIPGTTDPAVILDLLPLCRNYVRRVHVDQFLPPVQLPAQLRPGDQSDSGSEGEMEEPTVDHYQLGDLVAGLSHLEELDLVYDVKDCGMNFEWNLFLFTYRDCLSLAAAIKACHTLKDGGKQLLEGMSDNKTLLEFDLRLSDVAQESEYLIGQALYANREAARQRALNPSHFMSTITANGPENSVG

SEQ ID NO: 66651 - protein, 198 aa, Homo sapiens; identical to SEQ ID NO: 66650

SEQ ID NO: 66652 - protein, 501 aa, Homo sapiens
MQDTVTTSALLDPSHSSVSTQDNSSTGGHTSSTSPQLSKPSITPVPAKSRNPHPRANIRRMRRIIAEDPEWSLAIVPLLTELCIQHIIRNFQKNPILKQMLPEHQQKVLNHLSPDLPLAVTANLIDSENYWLRCCMHRWPVCHVAHHGGSWKRMFFERHLENLLKHFIPGTTDPAVILDLLPLCRNYVRRVHVDQFLPPVQLPAQLRPGDQSDSGSEGEMEEPTVDHYQLGDLVAGLSHLEELDLVYDVKDCGMNFEWNLFLFTYRDCLSLAAAIKACHTLKIFKLTRSKVDDDKARIIIRSLLDHPVLEELDLSQNLIGDRGARGAAKLLSHSRLRVLNLANNQVRAPGAQSLAHALAHNTNLISLNLRLNCIEDEGGQALAHALQTNKCLTTLHLGGNELSEPTATLLSQVLAINTTLTSINLSCNHIGLDGGKQLLEGMSDNKTLLEFDLRLSDVAQESEYLIGQALYANREAARQRALNPSHFMSTITANGPENSVG

SEQ ID NO: 66653 - protein, 198 aa, Homo sapiens
MEKRGRGVKSSPIQTPNQTPQQAPVTPRKERRPSMFEKEAYTQILRERLRESIHNVQYVEPPFDDSIADIGKEWKSALAKLKFANSYRMEPLKKFQAHSVETKVQQILTESLKDVKYDDKVFSHLSLELADRILLAVKEFGYHRYKFIIKVLFIQKTGQAINIASRWIWDIAWDSWVAAKHEAESYVALVLVFALYYE

SEQ ID NO: 66654 - protein, 221 aa, Homo sapiens
MASRPLPPGRQEEENAKDSGRKPSPVRPRGCLPSIDEARPAGPGPAPASRRGSMLGLAASFSRRNSLVGPGAGPGGQRPSLGPVPPLGSRVSFSGLPLAPARWVAPSYRTEPVPGERWEAARAQRALEAALAAGLHDACYSSDEAARLVRELCEQVHVRLRELSPPRYKLVCSVVLGPRAGQGVHVVSRALWDVARDGLASVSYTNTSLFAVATVHGLYCE

SEQ ID NO: 66655 - protein, 221 aa, Homo sapiens; identical to SEQ ID NO: 66654

SEQ ID NO: 66656 - protein, 357 aa, Homo sapiens
MERMSDSADKPIDNDAEGVWSPDIEQSFQEALAIYPPCGRRKIILSDEGKMYGRNELIARYIKLRTGKTRTRKQVSSHIQVLARRKSRDFHSKLKVTSMDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 66657 - protein, 411 aa, Homo sapiens
MERMSDSADKPIDNDAEGVWSPDIEQSFQEALAIYPPCGRRKIILSDEGKMYGRNELIARYIKLRTGKTRTRKQVSSHIQVLARRKSRDFHSKLKDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSYNKHLFVHIGHANHSYSDPLLESVDIRQIYDKFPEKKGGLKELFGKGPQNAFFLVKFWADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 66658 - protein, 426 aa, Homo sapiens
IEPSSWSGSESPAENMERMSDSADKPIDNDAEGVWSPDIEQSFQEALAIYPPCGRRKIILSDEGKMYGRNELIARYIKLRTGKTRTRKQVSSHIQVLARRKSRDFHSKLKDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSYNKHLFVHIGHANHSYSDPLLESVDIRQIYDKFPEKKGGLKELFGKGPQNAFFLVKFWADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 66659 - protein, 330 aa, Homo sapiens
MRYVLSWCVTVTFKDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSYNKHLFVHIGHANHSYSDPLLESVDIRQIYDKFPEKKGGLKELFGKGPQNAFFLVKFWADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 66660 - protein, 68 aa, Homo sapiens
IEPSSWSGSESPAENMERMSDSADKPIDNDAEGVWSPDIEQSFQEALAIYPPCGRRKIILSDEGKMYG

SEQ ID NO: 66661 - protein, 426 aa, Homo sapiens; identical to SEQ ID NO: 66658

SEQ ID NO: 66662 - protein, 447 aa, Homo sapiens
MGEPRAGAALDDGSGWTGSEEGSEEGTGGSEGAGGDGGPDAEGVWSPDIEQSFQEALAIYPPCGRRKIILSDEGKMYGRNELIARYIKLRTGKTRTRKQVSSHIQVLARRKSREIQSKLKDQVSKDKAFQTMATMSSAQLISAPSLQAKLGPTGPQASELFQFWSGGSGPPWNVPDVKPFSQTPFTLSLTPPSTDLPGYEPPQALSPLPPPTPSPPAWQARGLGTARLQLVEFSAFVEPPDAVDSYQRHLFVHISQHCPSPGAPPLESVDVRQIYDKFPEKKGGLRELYDRGPPHAFFLVKFWADLNWGPSGEEAGAGGSISSGGFYGVSSQYESLEHMTLTCSSKVCSFGKQVVEKVETERAQLEDGRFVYRLLRSPMCEYLVNFLHKLRQLPERYMMNSVLENFTILQVVTNRDTQELLLCTAYVFEVSTSERGAQHHIYRLVRD

SEQ ID NO: 66663 - protein, 450 aa, Homo sapiens
MGEPRAGAALDDGSGWTGSEEGSEEGTGGSEGAGGDGGPDAEGVWSPDIEQSFQEALAIYPPCGRRKIILSDEGKMYGRNELIARYIKLRTGKTRTRKQVSSHIQVLARRKSREIQSKLKDQVSKDKAFQTMATMSSAQLISAPSLQAKLGPTGPQVVQASELFQFWSGGSGPPWNVPDVKPFSQTPFTLSLTPPSTDLPGYEPPQALSPLPPPTPSPPAWQARGLGTARLQLVEFSAFVEPPDAVDSYQRHLFVHISQHCPSPGAPPLESVDVRQIYDKFPEKKGGLRELYDRGPPHAFFLVKFWADLNWGPSGEEAGAGGSISSGGFYGVSSQYESLEHMTLTCSSKVCSFGKQVVEKVETERAQLEDGRFVYRLLRSPMCEYLVNFLHKLRQLPERYMMNSVLENFTILQVVTNRDTQELLLCTAYVFEVSTSERGAQHHIYRLVRD

SEQ ID NO: 66664 - protein, 319 aa, Homo sapiens
MATMSSAQLISAPSLQAKLGPTGPQVVQASELFQFWSGGSGPPWNVPDVKPFSQTPFTLSLTPPSTDLPGYEPPQALSPLPPPTPSPPAWQARGLGTARLQLVEFSAFVEPPDAVDSYQRHLFVHISQHCPSPGAPPLESVDVRQIYDKFPEKKGGLRELYDRGPPHAFFLVKFWADLNWGPSGEEAGAGGSISSGGFYGVSSQYESLEHMTLTCSSKVCSFGKQVVEKVETERAQLEDGRFVYRLLRSPMCEYLVNFLHKLRQLPERYMMNSVLENFTILQVVTNRDTQELLLCTAYVFEVSTSERGAQHHIYRLVRD

SEQ ID NO: 66665 - protein, 451 aa, Homo sapiens
MGEPRAGAALDDGSGWTGSEEGSEEGTGGSEGAGGDGGPDAEGVWSPDIEQSFQEALAIYPPCGRRKIILSDEGKMYGRNELIARYIKLRTGKTRTRKQVSSHIQVLARRKSREIQSKLKALNVDQVSKDKAFQTMATMSSAQLISAPSLQAKLGPTGPQASELFQFWSGGSGPPWNVPDVKPFSQTPFTLSLTPPSTDLPGYEPPQALSPLPPPTPSPPAWQARGLGTARLQLVEFSAFVEPPDAVDSYQRHLFVHISQHCPSPGAPPLESVDVRQIYDKFPEKKGGLRELYDRGPPHAFFLVKFWADLNWGPSGEEAGAGGSISSGGFYGVSSQYESLEHMTLTCSSKVCSFGKQVVEKVETERAQLEDGRFVYRLLRSPMCEYLVNFLHKLRQLPERYMMNSVLENFTILQVVTNRDTQELLLCTAYVFEVSTSERGAQHHIYRLVRD

SEQ ID NO: 66666 - protein, 451 aa, Homo sapiens; identical to SEQ ID NO: 66665

SEQ ID NO: 66667 - protein, 450 aa, Homo sapiens; identical to SEQ ID NO: 66663

SEQ ID NO: 66668 - protein, 435 aa, Homo sapiens
IASNSWNASSSPGEAREDGPEGLDKGLDNDAEGVWSPDIEQSFQEALAIYPPCGRRKIILSDEGKMYGRNELIARYIKLRTGKTRTRKQVSSHIQVLARKKVREYQVGIKAMNLDQVSKDKALQSMASMSSAQIVSASVLQNKFSPPSPLPQAVFSTSSRFWSSPPLLGQQPGPSQDIKPFAQPAYPIQPPLPPTLSSYEPLAPLPSAAASVPVWQDRTIASSRLRLLEYSAFMEVQRDPDTYSKHLFVHIGQTNPAFSDPPLEAVDVRQIYDKFPEKKGGLKELYEKGPPNAFFLVKFWADLNSTIQEGPGAFYGVSSQYSSADSMTISVSTKVCSFGKQVVEKVETEYARLENGRFVYRIHRSPMCEYMINFIHKLKHLPEKYMMNSVLENFTILQVVTSRDSQETLLVIAFVFEVSTSEHGAQHHVYKLVKD

SEQ ID NO: 66669 - protein, 451 aa, Homo sapiens
LSRPVGSGPEPRATSTIASNSWNASSSPGEAREDGPEGLDKGLDNDAEGVWSPDIEQSFQEALAIYPPCGRRKIILSDEGKMYGRNELIARYIKLRTGKTRTRKQVSSHLQVLARRKSREIQSKLKSSPQDQVSKDKALQSMASMSSAQIVSASVLQNKFSPPSPLPQAVFSTSSRFWSSPPLLGQQPGPSQDIKPFAQPAYPIQPPLPPTLSSYEPLAPLPSAAASVPVWQDRTIASSRLRLLEYSAFMEVQRDPDTYSKHLFVHIGQTNPAFSDPPLEAVDVRQIYDKFPEKKGGLKELYEKGPPNAFFLVKFWADLNSTIQEGPGAFYGVSSQYSSADSMTISVSTKVCSFGKQVVEKVETEYARLENGRFVYRIHRSPMCEYMINFIHKLKHLPEKYMMNSVLENFTILQVVTSRDSQETLLVIAFVFEVSTSEHGAQHHVYKLVKD

SEQ ID NO: 66670 - protein, 391 aa, Homo sapiens
LEGTAGTITSNEWSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 66671 - protein, 434 aa, Homo sapiens
LEGTAGTITSNEWSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKDQAAKDKALQSMAAMSSAQIISATAFHSSMALARGPGRPAVSGFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 66672 - protein, 305 aa, Homo sapiens
MAAMSSAQIISATAFHSSMALARGPGRPAVSGFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 66673 - protein, 72 aa, Homo sapiens
LEGTAGTITSNEWSSPTSPEGSTASGGSQALDKPIDNDAEGVWSPDIEQSFQEALAIYPPCGRRKIILSDEG

SEQ ID NO: 66674 - protein, 22 aa, Homo sapiens
LEGTAGTITSNEWSSPTSPEGS

SEQ ID NO: 66675 - protein, 175 aa, Homo sapiens
LEGTAGTITSNEWSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKDQAAKDKALQSMAAMSSAQIISATAFHSSMALARGPGRPAVSGFWQGALPGQAGTSH

SEQ ID NO: 66676 - protein, 1032 aa, Homo sapiens
MCNEETEIKEAQSYQNSPVSSATNQDAGYGSPFSESSDQLAHFKGSSSREEKEDPQCPDSVSYPQDSLAQIKAVYANLFSESCWSSLALDLKKSGSTTSTNDASQKESSAPTPTPPTCPVSTTGPTTSTPSTSCSSSTSHSSTTSTSSSSGYDWHQAALAKTLQQTSSYGLLPEPSLFSTVQLYRQNNKLYGSVFTGASKFRCKDCSAAYDTLVELTVHMNETGHYRDDNRDKDSEKTKRWSKPRKRSLMEMEGKEDAQKVLKCMYCGHSFESLQDLSVHMIKTKHYQKVPLKEPVPAITKLVPSTKKRALQDLAPPCSPEPAGMAAEVALSESAKDQKAANPYVTPNNRYGYQNGASYTWQFEARKAQILKCMECGSSHDTLQQLTAHMMVTGHFLKVTTSASKKGKQLVLDPVVEEKIQSIPLPPTTHTRLPASSIKKQPDSPAGSTTSEEKKEPEKEKPPVAGDAEKIKEESEDSLEKFEPSTLYPYLREEDLDDSPKGGLDILKSLENTVSTAISKAQNGAPSWGGYPSIHAAYQLPGTVKPLPAAVQSVQVQPSYAGGVKSLSSAEHNALLHSPGSLTPPPHKSNVSAMEELVEKVTGKVNIKKEERPPEKEKSSLAKAASPIAKENKDFPKTEEVSGKPQKKGPEAETGKAKKEGPLDVHTPNGTEPLKAKVTNGCNNLGIIMDHSPEPSFINPLSALQSIMNTHLGKVSKPVSPSLDPLAMLYKISNSMLDKPVYPATPVKQADAIDRYYYENSDQPIDLTKSKNKPLVSSVADSVASPLRESALMDISDMVKNLTGRLTPKSSTPSTVSEKSDADGSSFEEALDELSPVHKRKGRQSNWNPQHLLILQAQFASSLRETTEGKYIMSDLGPQERVHISKFTGLSMTTISHWLANVKYQLRRTGGTKFLKNLDTGHPVFFCNDCASQFRTASTYISHLETHLGFSLKDLSKLPLNQIQEQQNVSKVLTNKTLGPLGATEEDLGSTFQCKLCNRTFASKHAVKLHLSKTHGKSPEDHLIYVTELEKQ

SEQ ID NO: 66677 - protein, 78 aa, Homo sapiens
MCNEETEIKEAQSYQNSPVSSATNQDAGYGSPFSESSDQLAHFKGSSSREEKEDPQCPDSVSYPQDSLAQIKAVYANL

SEQ ID NO: 66678 - protein, 106 aa, Homo sapiens
MCNEETEIKEAQSYQNSPVSSATNQDAGYGSPFSESSDQLAHFKGSSSREEKEDPQCPDSVSYPQDSLAQIKAVYANLFSESCWSSLALDLKKSGSTTSTNDASQK

SEQ ID NO: 66679 - protein, 1031 aa, Homo sapiens
MMAAALLHYTGYAQEEQLKEEEEIKEEEEEEDSGSVAQLQGGNDTGTDEELETGPEQKGCFSYQNSPGSHLSNQDAENESLLSDASDQVSDIKSVCGRDASDKKAHTHVRLPNEAHNCMDKMTAVYANILSDSYWSGLGLGFKLSNSERRNCDTRNGSNKSDFDWHQDALSKSLQQNLPSRSVSKPSLFSSVQLYRQSSKMCGTVFTGASRFRCRQCSAAYDTLVELTVHMNETGHYQDDNRKKDKLRPTSYSKPRKRAFQDMDKEDAQKVLKCMFCGDSFDSLQDLSVHMIKTKHYQKVPLKEPVPTISSKMVTPAKKRVFDVNRPCSPDSTTGSFADSFSSQKNANLQLSSNNRYGYQNGASYTWQFEACKSQILKCMECGSSHDTLQQLTTHMMVTGHFLKVTSSASKKGKQLVLDPLAVEKMQSLSEAPNSDSLAPKPSSNSASDCTASTTELKKESKKERPEETSKDEKVVKSEDYEDPLQKPLDPTIKYQYLREEDLEDGSKGGGDILKSLENTVTTAINKAQNGAPSWSAYPSIHAAYQLSEGTKPPLPMGSQVLQIRPNLTNKLRPIAPKWKVMPLVSMPTHLAPYTQVKKESEDKDEAVKECGKESPHEEASSFSHSEGDSFRKSETPPEAKKTELGPLKEEEKLMKEGSEKEKPQPLEPTSALSNGCALANHAPALPCINPLSALQSVLNNHLGKATEPLRSPSCSSPSSSTISMFHKSNLNVMDKPVLSPASTRSASVSRRYLFENSDQPIDLTKSKSKKAESSQAQSCMSPPQKHALSDIADMVKVLPKATTPKPASSSRVPPMKLEMDVRRFEDVSSEVSTLHKRKGRQSNWNPQHLLILQAQFASSLFQTSEGKYLLSDLGPQERMQISKFTGLSMTTISHWLANVKYQLRKTGGTKFLKNMDKGHPIFYCSDCASQFRTPSTYISHLESHLGFQMKDMTRLSVDQQSKVEQEISRVSSAQRSPETIAAEEDTDSKFKCKLCCRTFVSKHAVKLHLSKTHSKSPEHHSQFVTDVDEE

SEQ ID NO: 66680 - protein, 1034 aa, Homo sapiens
MPRRKQQAPKRAAGYAQEEQLKEEEEIKEEEEEEDSGSVAQLQGGNDTGTDEELETGPEQKGCFSYQNSPGSHLSNQDAENESLLSDASDQVSDIKSVCGRDASDKKAHTHVRLPNEAHNCMDKMTAVYANILSDSYWSGLGLGFKLSNSERRNCDTRNGSNKSDFDWHQDALSKSLQQNLPSRSVSKPSLFSSVQLYRQSSKMCGTVFTGASRFRCRQCSAAYDTLVELTVHMNETGHYQDDNRKKDKLRPTSYSKPRKRAFQDMDKEDAQKVLKCMFCGDSFDSLQDLSVHMIKTKHYQKVPLKEPVPTISSKMVTPAKKRVFDVNRPCSPDSTTGSFADSFSSQKNANLQLSSNNRYGYQNGASYTWQFEACKSQILKCMECGSSHDTLQQLTTHMMVTGHFLKVTSSASKKGKQLVLDPLAVEKMQSLSEAPNSDSLAPKPSSNSASDCTASTTELKKESKKERPEETSKDEKVVKSEDYEDPLQKPLDPTIKYQYLREEDLEDGSKGGGDILKSLENTVTTAINKAQNGAPSWSAYPSIHAAYQLSEGTKPPLPMGSQVLQIRPNLTNKLRPIAPKWKVMPLVSMPTHLAPYTQVKKESEDKDEAVKECGKESPHEEASSFSHSEGDSFRKSETPPEAKKTELGPLKEEEKLMKEGSEKEKPQPLEPTSALSNGCALANHAPALPCINPLSALQSVLNNHLGKATEPLRSPSCSSPSSSTISMFHKSNLNVMDKPVLSPASTRSASVSRRYLFENSDQPIDLTKSKSKKAESSQAQSCMSPPQKHALSDIADMVKVLPKATTPKPASSSRVPPMKLEMDVRRFEDVSSEVSTLHKRKGRQSNWNPQHLLILQAQFASSLFQTSEGKYLLSDLGPQERMQISKFTGLSMTTISHWLANVKYQLRKTGGTKFLKNMDKGHPIFYCSDCASQFRTPSTYISHLESHLGFQMKDMTRLSVDQQSKVEQEISRVSSAQRSPETIAAEEDTDSKFKCKLCCRTFVSKHAVKLHLSKTHSKSPEHHSQFVTDVDEE

SEQ ID NO: 66681 - protein, 1081 aa, Homo sapiens
MPRRKQQAPRRAAAYVSEELKAAALVDEGLDPEEHTADGEPSAKYMCPEKELARACPSYQNSPAAEFSCHEMDSESHISETSDRMADFESGSIKNEEETKEVTVPLEDTTVSDSLEQMKAVYNNFLSNSYWSNLNLNLHQPSSEKNNGSSSSSSSSSSSCGSGSFDWHQSAMAKTLQQVSQSRMLPEPSLFSTVQLYRQSSKLYGSIFTGASKFRCKDCSAAYDTLVELTVHMNETGHYRDDNHETDNNNPKRWSKPRKRSLLEMEGKEDAQKVLKCMYCGHSFESLQDLSVHMIKTKHYQKVPLKEPVTPVAAKIIPATRKKASLELELPSSPDSTGGTPKATISDTNDALQKNSNPYITPNNRYGHQNGASYAWHFEARKSQILKCMECGSSHDTLQELTAHMMVTGHFIKVTNSAMKKGKPIVETPVTPTITTLLDEKVQSVPLAATTFTSPSNTPASISPKLNVEVKKEVDKEKAVTDEKPKQKDKPGEEEEKCDISSKYHYLTENDLEESPKGGLDILKSLENTVTSAINKAQNGTPSWGGYPSIHAAYQLPNMMKLSLGSSGKSTPLKPMFGNSEIVSPTKNQTLVSPPSSQTSPMPKTNFHAMEELVKKVTEKVAKVEEKMKEPDGKLSPPKRATPSPCSSEVGEPIKMEASSDGGFRSQENSPSPPRDGCKDGSPLAEPVENGKELVKPLASSLSGSTAIITDHPPEQPFVNPLSALQSVMNIHLGKAAKPSLPALDPMSMLFKMSNSLAEKAAVATPPPLQSKKADHLDRYFYHVNNDQPIDLTKGKSDKGCSLGSVLLSPTSTAPATSSSTVTTAKTSAVVSFMSNSPLRENALSDISDMLKNLTESHTSKSSTPSSISEKSDIDGATLEEAEESTPAQKRKGRQSNWNPQHLLILQAQFAASLRQTSEGKYIMSDLSPQERMHISRFTGLSMTTISHWLANVKYQLRRTGGTKFLKNLDTGHPVFFCNDCASQIRTPSTYISHLESHLGFRLRDLSKLSTEQINSQIAQTKSPSEKMVTSSPEEDLGTSYQCKLCNRTFASKHAVKLHLSKTHGKSPEDHLLYVSELEKQ

SEQ ID NO: 66682 - protein, 631 aa, Homo sapiens
MNFNTILEEILIKRSQQKKKTSPLNYKERLFVLTKSMLTYYEGRAEKKYRKGFIDVSKIKCVEIVKNDDGVIPCQNKYPFQVVHDANTLYIFAPSPQSRDLWVKKLKEEIKNNNNIMIKYHPKFWTDGSYQCCRQTEKLAPGCEKYNLFESSIRKALPPAPETKKRRPPPPIPLEEEDNSEEIVVAMYDFQAAEGHDLRLERGQEYLILEKNDVHWWRARDKYGNEGYIPSNYVTGKKSNNLDQYEWYCRNMNRSKAEQLLRSEDKEGGFMVRDSSQPGLYTVSLYTKFGGEGSSGFRHYHIKETTTSPKKYYLAEKHAFGSIPEIIEYHKHNAAGLVTRLRYPVSVKGKNAPTTAGFSYEKWEINPSELTFMRELGSGLFGVVRLGKWRAQYKVAIKAIREGAMCEEDFIEEAKVMMKLTHPKLVQLYGVCTQQKPIYIVTEFMERGCLLNFLRQRQGHFSRDVLLSMCQDVCEGMEYLERNSFIHRDLAARNCLVSEAGVVKVSDFGMARYVLDDQYTSSSGAKFPVKWCPPEVFNYSRFSSKSDVWSFGVLMWEVFTEGRMPFEKYTNYEVVTMVTRGHRLYQPKLASNYVYEVMLRCWQEKPEGRPSFEDLLRTIDELVECEETFGR

SEQ ID NO: 66683 - protein, 697 aa, Homo sapiens
MGFQPPAALLLRLFLLQGILRLLWGDLAFIPPFIRMSGPAVSASLVGDTEGVTVSLAVLQDEAGILPIPTCGVLNNETEDWSVTVIPGAKVLEVTVRWKRGLDWCSSNETDSFSESPCILQTLLVSASHNSSCSAHLLIQVEIYANSSLTHNASENVTVIPNQVYQPLGPCPCNLTAGACDVRCCCDQECSSNLTTLFRRSCFTGVFGGDVNPPFDQLCSAGTTTRGVPDWFPFLCVQSPLANTPFLGYFYHGAVSPKQDSSFEVYVDTDAKDFADFGYKQGDPIMTVKKAYFTIPQVSLAGQCMQNAPVAFLHNFDVKCVTNLELYQERDGIINAKIKNVALGGIVTPKVIYEEATDLDKFITNTETPLNNGSTPRIVNVEEHYIFKWNNNTISEINVKIFRAEINAHQKGIMTQRFVVKFLSYNSGNEEELSGNPGYQLGKPVRALNINRMNNVTTLHLWQSAGRGLCTSATFKPILFGENVLSGCLLEVGINENCTQLRENAVERLDSLIQATHVAMRGNSDYADLSDGWLEIIRVDAPDPGADPLASSVNGMCLDIPAHLSIRILISDAGAVEGITQQEILGVETRFSSVNWQYQCGLTCEHKADLLPISASVQFIKIPAQLPHPLTRFQINYTEYDCNRNEVCWPQLLYPWTQYYQGELHSQCVAKGLLLLLFLTLALFLSNPWTRICKAYS

SEQ ID NO: 66684 - protein, 696 aa, Homo sapiens
MGFQPPAALLLRLFLLQGILRLLWGDLAFIPPFIRMSGPAVSASLVGDTEGVTVSLAVLQDEAGILPIPTCGVLNNETEDWSVTVIPGAVLEVTVRWKRGLDWCSSNETDSFSESPCILQTLLVSASHNSSCSAHLLIQVEIYANSSLTHNASENVTVIPNQVYQPLGPCPCNLTAGACDVRCCCDQECSSNLTTLFRRSCFTGVFGGDVNPPFDQLCSAGTTTRGVPDWFPFLCVQSPLANTPFLGYFYHGAVSPKQDSSFEVYVDTDAKDFADFGYKQGDPIMTVKKAYFTIPQVSLAGQCMQNAPVAFLHNFDVKCVTNLELYQERDGIINAKIKNVALGGIVTPKVIYEEATDLDKFITNTETPLNNGSTPRIVNVEEHYIFKWNNNTISEINVKIFRAEINAHQKGIMTQRFVVKFLSYNSGNEEELSGNPGYQLGKPVRALNINRMNNVTTLHLWQSAGRGLCTSATFKPILFGENVLSGCLLEVGINENCTQLRENAVERLDSLIQATHVAMRGNSDYADLSDGWLEIIRVDAPDPGADPLASSVNGMCLDIPAHLSIRILISDAGAVEGITQQEILGVETRFSSVNWQYQCGLTCEHKADLLPISASVQFIKIPAQLPHPLTRFQINYTEYDCNRNEVCWPQLLYPWTQYYQGELHSQCVAKGLLLLLFLTLALFLSNPWTRICKAYS

SEQ ID NO: 66685 - protein, 607 aa, Homo sapiens
MRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 66686 - protein, 429 aa, Homo sapiens
MDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 66687 - protein, 443 aa, Homo sapiens
MRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSVSFLELGGLLQPNEKSCKGFQTYVRLAKGEEFFVHYNEVLIY

SEQ ID NO: 66688 - protein, 625 aa, Homo sapiens
MRLETAEAYVGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 66689 - protein, 459 aa, Homo sapiens
MRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNCFLESKSTTCTRFFKNLASSCTLDSALNAASYYNFTVLKVPRSMTDPQNMEAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 66690 - protein, 2155 aa, Homo sapiens
MNYSSFLRIWVSFIFALVQHQAQPRELMYPFWQNDTKTPKVDDGSSSEIKLAIPVFFFGVPYRTVYVNNNGVVSFNVLVSQFTPESFPLTDGRAFVAPFWADVHNGIRGEIYYRETMEPAILKRATKDIRKYFKDMATFSATWVFIVTWEEVTFYGGSSTTPVNTFQAVLVSDGSYTFTLFNYYEINWTTGTASGGDPLTGLGGVMAQAGFNGGNLTNFFSLPGSRTPEIVNIQETTNVNVPGRWAFKVDGKEIDPANGCTSRGQFLRRGEVFWDDLNCTVKCRCLDFNNEIYCQEASCSPYEVCEPKGKFFYCSAVETSTCVVFGEPHYHTFDGFLFHFQGSCAYLLARQCLQTSSLPFFSVEAKNEHRRGSAVSWVKELSVEVNGYKILIPKGSYGRVKVNDLVTSLPVTLDLGTVKIYQSGISTAVETDFGLLVTFDGQHYASISVPGSYINSTCGLCGNYNKNPLDDFLRPDGRPAMSVLDLGESWRVYHADWKCDSGCVDNCTQCDAATEALYFGSDYCGFLNKTDGPLWECGTVVDPTAFVHSCVYDLCSVRDNGTLLCQAIQAYALVCQALGIPIGDWRTQTGCVSTVQCPSFSHYSVCTSSCPDTCSDLTASRNCATPCTEGCECNQGFVLSTSQCVPLHKCGCDFDGHYYTMGEFFWATANCTVQCLCEEGGDVYCFNKTCGSGEVCAVEDGYQGCFPKRETVCLLSQNQVLHTFDGASYAFPSEFSYTLLKTCPERPEYLEIDINKKKPDAGPAWLRGLRILVADQEVKIGGIGASEVKLNGQEVELPFFHPSGKLEIYRNKNSTTVESKGVVTVQYSDIGLLYIRLSTTYFNCTGGLCGFYNANASDEFCLPNGKCTDNLAVFLESWTTFEEICNGECGDLLKACNNDSELLKFYRSRSRCGIINDPSNSSFLECHGVVNVTAYYRTCLFRLCQSGGNESELCDSVARYASACKNADVEVGPWRTYDFCPLECPENSHFEECITCTETCETLTLGPICVDSCSEGCQCDEGYALLGSQCVTRSECGCNFEGHQLATNETFWVDLDCQIFCYCSGTDNRVHCETIPCKDDEYCMEEGGLYYCQARTDASCIVSGYGHYLTFDGFPFDFQTSCPLILCTTGSRPSSDSFPKFVVTAKNEDRDPSLALWVKQVDVTVFGYSIVIHRAYKHTVLVNSERLYLPLKLGQGKINIFSFGFHVVVETDFGLKVVYDWKTFLSITVPRSMQNSTYGLCGRYNGNPDDDLEMPMGLLASSVNEFGQSWVKRDTFCQVGCGDRCPSCAKVEGFSKVQQLCSLIPNQNAAFSKCHSKVNPTFFYKNCLFDSCIDGGAVQTACSWLQNYASTCQTQGITVTGWRNYTSCTVTCPPNSHYESCVSVCQPRCAAIRLKSDCSHYCVEGCHCDAGYVLNGKSCILPHSCGCYSDGKYYEPKQLFWNSDCTRRCRCFRRNVIQCDPRQCKSDEECALRNGVRGCFSTKTSYCLAAGGGVFRTFDGAFLRFPANCAFVLSTICQKLPDISFQLIINFDKWSAPNLTIISPVYFYINEEQILINDRNTVKVNGTQVNVPFITGLATKIYSSEGFLVIDTSPDIQIYYNGFNVIKISISERLQNKVCGLCGNFNGDLTDDYVTLRGKPVVSSVVLAQSWKTNGMQKRPLAPSCNELQFSQYAAMCDNVHIQKMQGDGYCLKLTDMKGFFQPCYGLLDPLPFYESCYLDGCYSHKKFQLCGSLAAYGEACRSFGILSTEWIEKENCSGVVEDPCVGADCPNRTCELGNGRELCGCIEPPPYGNNSHDIIDAEVTCKAAQMEVSISKCKLFQLGFEREGVRINDRQCTGIEGEDFISFQINNTKGNCGNIVQSNGTHIMYKNTLWIESANNTGNIITRDRTINVEFSCAYELDIKISLDSVVKPMLSVINLTVPTQEGSFITKMALYKNASYKHPYRQGEVVLTTRDVLYVGVFVVGADATHLILTLNKCYATPTRDSNDKLRYFIIEGGCQNLKDNTIGIEENAVSLTCRFHVTVFKFIGDYDEVHLHCAVSLCDSEKYSCKITCPHNSRIATDYTKEPKEQIISVGPIRRKRLDWCEDNGGCEQICTSRVDGPLCSCVTGTLQEDGKSCRASNSSMELQVWTLLLIMIQISLWHFVYKSGTTS

SEQ ID NO: 66691 - protein, 2155 aa, Homo sapiens; identical to SEQ ID NO: 66690

SEQ ID NO: 66692 - protein, 418 aa, Homo sapiens
MAKLLQPPPKFLPSEWHIANKNQYHRADAQRSRSERLVAESQRLVDEIEKTTRKSQSDVNKKLEQRLEEVQFWKKELDDKLEQLVNVTDDLLIYKIRLEKALETLKEPLHITETCLAYREKRIGIDLVHDTVEHELIKEAEIIQGIMALLTRTLEEASEQIRMNRSAKYNLEKDLKDKFVALTIDDICFSLNNNSPNIRYSENAVRIEPNSVSLEDWLDFSSTNVEKADKQRNNSLMLKALVDRILSQTANDLRKQCDVVDTAFKNGLKDTKDARDKLADHLAKVMEEIASQEKNITALEKAILDQEGPAKVAHTRLETRTHRPNVELCRDVAQYRLMKEVQEITHNVARLKETLAQAQAELKGLHRRQLALQEEIQVKENTIYIDEVLCMQMRKSIPLRDGEDHGVWAGGLRPDAVC

SEQ ID NO: 66693 - protein, 272 aa, Homo sapiens
MALLTRTLEEASEQIRMNRSAKYNLEKDLKDKFVALTIDDICFSLNNNSPNIRYSENAVRIEPNSVSLEDWLDFSSTNVEKADKQRNNSLMLKALVDRILSQTANDLRKQCDVVDTAFKNGLKDTKDARDKLADHLAKVMEEIASQEKNITALEKAILDQEGPAKVAHTRLETRTHRPNVELCRDVAQYRLMKEVQEITHNVARLKETLAQAQAELKGLHRRQLALQEEIQVKENTIYIDEVLCMQMRKSIPLRDGEDHGVWAGGLRPDAVC

SEQ ID NO: 66694 - protein, 490 aa, Homo sapiens
MERVGCTLTTTYAHPRPTPTNFLPAISTMASSYRDRFPHSNLTHSLSLPWRPSTYYKVASNSPSVAPYCTRSQRVSENTMLPFVSNRTTFFTRYTPDDWYRSNLTNYQESNTSRHNSEKLRVDTSRLIQDKYQQTRKTQADTTQNLGERVNDIGFWKSEIIHELDEMIGETNALTDVKKRLERALMETEAPLQVARECLFHREKRMGIDLVHDEVEAQLLTEVDTILCCQERMKLHLDKAIAQLAANRASQHELEKDLSDKQTAYRIDDKCHHLRNTSDGVGYFRGVERVDATVSVPESWAKFTDDNILRSQSERAASAKLRDDIENLLVVTANEMWNQFNKVNLSFTNRIAETADAKNKIQTHLAKTLQEIFQTEMTIESIKKAIKDKTAFLKVAQTRLDERTRRPNIELCRDMAQLRLVNEVHEVDDTIQTLQQRLRDAEDTLQSLVHIKATLEYDLAVKANSLYIDQEKCMSMRKSYPNTLRLVGFC

SEQ ID NO: 66695 - protein, 490 aa, Homo sapiens; identical to SEQ ID NO: 66694

SEQ ID NO: 66696 - protein, 147 aa, Homo sapiens
MERVGCTLTTTYAHPRPTPTNFLPAISTMASSYRDRFPHSNLTHSLSLPWRPSTYYKVASNSPSVAPYCTRSQRVSENTMLPFVSNRTTFFTRYTPDDWYRSNLTNYQESNTSRHNSEKLRVDTSRLIQDKYQQTRKTQADTTQNLG

SEQ ID NO: 66697 - protein, 140 aa, Homo sapiens
MERVGCTLTTTYAHPRPTPTNFLPAISTMASSYRDRFPHSNLTHSLSLPWRPSTYYKVASNSPSVAPYCTRSQRVSENTMLPFVSNRTTFFTRYTPDDWYRSNLTNYQESNTSRHNSEKLRVDTSRLIQDKYQQTRKTQA

SEQ ID NO: 66698 - protein, 82 aa, Homo sapiens
MERVGCTLTTTYAHPRPTPTNFLPAISTMASSYRDRFPHSNLTHSLSLPWRPSTYYKVASNSPSVAPYCTRSQRVSENTMLP

SEQ ID NO: 66699 - protein, 837 aa, Homo sapiens
MEPAPSEVRLAVREAIHALSSSEDGGHIFCTLESLKRYLGEMEPPALPREKEEFASAHFSPVLRCLASRLSPAWLELLPHGRLEELWASFFLEGPADQAFLVLMETIEGAAGPSFRLMKMARLLARFLREGRLAVLMEAQCRQQTQPGFILLRETLLGKVVALPDHLGNRLQQENLAEFFPQNYFRLLGEEVVRVLQAVVDSLQGGLDSSVSFVSQVLGKACVHGRQQEILGVLVPRLAALTQGSYLHQRVCWRLVEQVPDRAMEAVLTGLVEAALGPEVLSRLLGNLVVKNKKAQFVMTQKLLFLQSRLTTPMLQSLLGHLAMDSQRRPLLLQVLKELLETWGSSSAIRHTPLPQQRHVSKAVLICLAQLGEPELRDSRDELLASMMAGVKCRLDSSLPPVRRLGMIVAEVVSARIHPEGPPLKFQYEEDELSLELLALASPQPAGDGASEAGTSLVPATAEPPAETPAEIVDGGVPQAQLAGSDSDLDSDDEFVPYDMSGDRELKSSKAPAYVRDCVEALTTSEDIERWEAALRALEGLVYRSPTATREVSVELAKVLLHLEEKTCVVGFAGLRQRALVAVTVTDPAPVADYLTSQFYALNYSLRQRMDILDVLTLAAQELSRPGCLGRTPQPGSPSPNTPCLPEAAVSQPGSAVASDWRVVVEERIRSKTQRLSKGGPRQGPAGSPSRFNSVAGHFFFPLLQRFDRPLVTFDLLGEDQLVLGRLAHTLGALMCLAVNTTVAVAMGKALLEFVWALRFHIDAYVRQGLLSAVSSVLLSLPAARLLEDLMDELLEARSWLADVAEKDPDEDCRTLALRALLLLQRLKNRLLPPASP

SEQ ID NO: 66700 - protein, 360 aa, Homo sapiens
MMAGVKCRLDSSLPPVRRLGMIVAEVVSARIHPEGPPLKFQYEEDELSLELLALASPQPAGDGASEAGTSLVPATAEPPAETPAEIVDGGVPQAQLAGSDSDLDSDDEFVPYDMSGDRELKSSKAPAYVRDCVEVLDVLTLAAQELSRPGCLGRTPQPGSPSPNTPCLPEAAVSQPGSAVASDWRVVVEERIRSKTQRLSKGGPRQGPAGSPSRFNSVAGHFFFPLLQRFDRPLVTFDLLGEDQLVLGRLAHTLGALMCLAVNTTVAVAMGKALLEFVWALRFHIDAYVRQGLLSAVSSVLLSLPAARLLEDLMDELLEARSWLADVAEKDPDEDCRTLALRALLLLQRLKNRLLPPASP

SEQ ID NO: 66701 - protein, 1089 aa, Homo sapiens
MAVFDTPEEAFGVLRPVCVQLTKTQTVENVEHLQTRLQAVSDSALQELQQYILFPLRFTLKTPGPKRERLIQSVVECLTFVLSSTCVKEQELLQELFSELSACLYSPSSQKPAAVSEELKLAVIQGLSTLMHSAYGDIILTFYEPSILPRLGFAVSLLLGLAEQEKSKQIKIAALKCLQVLLLQCDCQDHPRSLDELEQKQLGDLFASFLPGISTALTRLITGDFKQGHSIVVSSLKIFYKTVSFIMADEQLKRISKVQAKPAVEHRVAELMVYREADWVKKTGDKLTILIKKIIECVSVHPHWKVRLELVELVEDLLLKCSQSLVECAGPLLKALVGLVNDESPEIQAQCNKVLRHFADQKVVVGNKALADILSESLHSLATSLPRLMNSQDDQGKFSTLSLLLGYLKLLGPKINFVLNSVAHLQRLSKALIQVLELDVADIKIVEERRWNSDDLNASPKTSATQPWNRIQRRYFRFFTDERIFMLLRQVCQLLGYYGNLYLLVDHFMELYHQSVVYRKQAAMILNELVTGAAGLEVEDLHEKHIKTNPEELREIVTSILEEYTSQENWYLVTCLETEEMGEELMMEHPGLQAITSGEHTCQVTSFLAFSKPSPTICSMNSNIWQICIQLEGIGQFAYALGKDFCLLLMSALYPVLEKAGDQTLLISQVATSTMMDVCRACGYDSLQHLINQNSDYLVNGISLNLRHLALHPHTPKVLEVMLRNSDANLLPLVADVVQDVLATLDQFYDKRAASFVSVLHALMAALAQWFPDTGNLGHLQEQSLGEEGSHLNQRPAALEKSTTTAEDIEQFLLNYLKEKDVADGNVSDFDNEEEEQSVPPKVDENDTRPDVEPPLPLQIQIAMDVMERCIHLLSDKNLQIRLKVLDVLDLCVVVLQSHKNQLLPLAHQAWPSLVHRLTRDAPLAVLRAFKVLRTLGSKCGDFLRSRFCKDVLPKLAGSLVTQAPISARAGPVYSHTLAFKLQLAVLQGLGPLCERLDLGEGDLNKVADACLIYLSVKQPVKLQEAARSVFLHLMKVDPDSTWFLLNELYCPVQFTPPHPSLHPVQLHGASGQQNPYTTNVLQLLKELQ

SEQ ID NO: 66702 - protein, 1089 aa, Homo sapiens; identical to SEQ ID NO: 66701

SEQ ID NO: 66703 - protein, 1089 aa, Homo sapiens; identical to SEQ ID NO: 66701

SEQ ID NO: 66704 - protein, 508 aa, Homo sapiens
MELDSALEAPSQEDSNLSEELSHSAFGQAFSKILHCLARPEARRGNVKDAVLKDLGDLIEATEFDRLFEGTGARLRGMPETLGQVAKALEKYAAPSKEEEGGGDGHSEAAEKAAQVGLLFLKLLGKVETAKNSLVGPAWQTGLHHLAGPVYIFAITHSLEQPWTTPRSREVAREVLTSLLQVTECGSVAGFLHGENEDEKGRLSVILGLLKPDLYKESWKNNPAIKHVFSWTLQQVTRPWLSQHLERVLPASLVISDDYQTENKILGVHCLHHIVLNVPAADLLQYNRAQVLYHAISNHLYTPEHHLIQAVLLCLLDLFPILEKTLHWKGDGARPTTHCDEVLRLILTHMEPEHRLLLRRTYARNLPAFVNRLGILTVRHLKRLERVIIGYLEVYDGPEEEARLKILETLKLLMQHTWPRVSCRLVVLLKALLKLICDVARDPNLTPESVKSALLQEATDCLILLDRCSQGRVKGLLAKIPQSCEDRKVVNYIRKVQQVSEGAPYNGT

SEQ ID NO: 66705 - protein, 508 aa, Homo sapiens; identical to SEQ ID NO: 66704

SEQ ID NO: 66706 - protein, 497 aa, Homo sapiens
MELDSALEAPSQEDSNLSEELSHSAFGQAFSKILHCLARPEARRGNVKDAVLKDLGDLIEATEFDRLFEGTGARLRGMPETLGQVAKALEKYAAPSKEEEGGGDGHSEAAEKAAQVGLLFLKLLGKVETAKNSLVGPAWQTGLHHLAGPVYIFAITHSLEQPWTTPRSREVAREVLTSLLQVTECGSVAGFLHGENEDEKGRLSVILGLLKPDLYKESWKNNPAIKHVFSWTLQQVTRPWLSQHLERVLPASLVISDDYQTENKILGVHCLHHIVLNVPAADLLQYNRAQVLYHAISNHLYTPEHHLIQAVLLCLLDLFPILEKTLHWKGDGARPTTHCDEVLRLILTHMEPEHRLLLRRTYARNLPAFVNRLERVIIGYLEVYDGPEEEARLKILETLKLLMQHTWPRVSCRLVVLLKALLKLICDVARDPNLTPESVKSALLQEATDCLILLDRCSQGRVKGLLAKIPQSCEDRKVVNYIRKVQQVSEGAPYNGT

SEQ ID NO: 66707 - protein, 101 aa, Homo sapiens
MELDSALEAPSQEDSNLSEELSHSAFGQAFSKILHCLARPEARRGNVKDAVLKDLGDLIEATEFDRLFEGTGARLRGMPETLGQVAKALEKYAAPSKEEEG

SEQ ID NO: 66708 - protein, 807 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVLRPVPGDPAGLHPLHAALQPVLRRHGEQAVCGDSAGRAAPAFGG

SEQ ID NO: 66709 - protein, 1132 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 66710 - protein, 1069 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 66711 - protein, 807 aa, Homo sapiens; identical to SEQ ID NO: 66708

SEQ ID NO: 66712 - protein, 123 aa, Homo sapiens
MMLPKPGTYYLPWEVSAGQVPDGSTLRTFGRLCLYDMIQSRVTLMAQHGSDQHQVLVCTKLVEPFHAQVGSLYIVLGELQHQQDRGSVVKARVLTCVEGMNLPLLEQAIREQRLYKQERGGSQ

SEQ ID NO: 66713 - protein, 122 aa, Homo sapiens
MLPKPGTYYLPWEVSAGQVPDGSTLRTFGRLCLYDMIQSRVTLMAQHGSDQHQVLVCTKLVEPFHAQVGSLYIVLGELQHQQDRGSVVKARVLTCVEGMNLPLLEQAIREQRLYKQERGGSQ

SEQ ID NO: 66714 - protein, 1837 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 66715 - protein, 1564 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 66716 - protein, 1655 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 66717 - protein, 2201 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 66718 - protein, 1079 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTITAKFTTDLDSPRDLTATEVQSETALLTWRPPRASVTGYLLVYESVDGTVKEVIVGPDTTSYSLADLSPPSLFLHFIQQKPEKQYCFHFKDMINIINIIMMMMMMKTKDFSRDLSFQNISGQYLIVFFF

SEQ ID NO: 66719 - protein, 92 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTV

SEQ ID NO: 66720 - protein, 1746 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTAKEPEIGNLNVSDITPESFNLSWMATDGIFETFTIEIIDSNRLLETVEYNISGAERTAHISGLPPSTDFIVYLSGLAPSIRTKTISATATTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 66721 - protein, 1838 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTAKEPEIGNLNVSDITPESFNLSWMATDGIFETFTIEIIDSNRLLETVEYNISGAERTAHISGLPPSTDFIVYLSGLAPSIRTKTISATATTEPKPQLGTLIFSNITPKSFNMSWTTQAGLFAKIVINVSDAHSLHESQQFTVSGDAKQAHITGLVENTGYDVSVAGTTLAGDPTRPLTAFVITEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 66722 - protein, 1358 aa, Homo sapiens
MGADGETVVLKNMLIGINLILLGSMIKPSECQLEVTTERVQRQSVEEEGGIANYNTSSKEQPVVFNHVYNINVPLDNLCSSGLEASAEQEVSAEDETLAEYMGQTSDHESQVTFTHRINFPKKACPCASSAQVLQELLSRIEMLEREVSVLRDQCNANCCQESAATGQLDYIPHCSGHGNFSFESCGCICNEGWFGKNCSEPYCPLGCSSRGVCVDGQCICDSEYSGDDCSELRCPTDCSSRGLCVDGECVCEEPYTGEDCRELRCPGDCSGKGRCANGTCLCEEGYVGEDCGQRQCLNACSGRGQCEEGLCVCEEGYQGPDCSAVAPPEDLRVAGISDRSIELEWDGPMAVTEYVISYQPTALGGLQLQQRVPGDWSGVTITELEPGLTYNISVYAVISNILSLPITAKVATHLSTPQGLQFKTITETTVEVQWEPFSFSFDGWEISFIPKNNEGGVIAQVPSDVTSFNQTGLKPGEEYIVNVVALKEQARSPPTSASVSTVIDGPTQILVRDVSDTVAFVEWIPPRAKVDFILLKYGLVGGEGGRTTFRLQPPLSQYSVQALRPGSRYEVSVSAVRGTNESDSATTQFTTEIDAPKNLRVGSRTATSLDLEWDNSEAEVQEYKVVYSTLAGEQYHEVLVPRGIGPTTRATLTDLVPGTEYGVGISAVMNSQQSVPATMNARTELDSPRDLMVTASSETSISLIWTKASGPIDHYRITFTPSSGIASEVTVPKDRTSYTLTDLEPGAEYIISVTAERGRQQSLESTVDAFTGFRPISHLHFSHVTSSSVNITWSDPSPPADRLILNYSPRDEEEEMMEVSLDATKRHAVLMGLQPATEYIVNLVAVHGTVTSEPIVGSITTGIDPPKDITISNVTKDSVMVSWSPPVASFDYYRVSYRPTQVGRLDSSVVPNTVTEFTITRLNPATEYEISLNSVRGREESERICTLVHTAMDNPVDLIATNITPTEALLQWKAPVGEVENYVIVLTHFAVAGETILVDGVSEEFRLVDLLPSTHYTATMYATNGPLTSGTISTNFSTLLDPPANLTASEVTRQSALISWQPPRAEIENYVLTYKSTDGSRKELIVDAEDTWIRLEGLLENTDYTVLLQAAQDTTWSSITSTAFTTGGRVFPHPQDCAQHLMNGDTLSGVYPIFLNGELSQKLQVYCDMTTDGGGWIVFQRRQNGQTDFFRKWADYRVGFGNVEDEFWLGLDNIHRITSQGRYELRVDMRDGQEAAFASYDRFSVEDSRNLYKLRIGSYNGTAGDSLSYHQGRPFSTEDRDNDVAVTNCAMSYKGAWWYKNCHRTNLNGKYGESRHSQGINWYHWKGHEFSIPFVEMKMRPYNHRLMAGRKRQSLQF

SEQ ID NO: 66723 - protein, 1268 aa, Homo sapiens
MGADGETVVLKNMLIGINLILLGSMIKPSECQLEVTTERVQRQSVEEEGGIANYNTSSKEQPVVFNHVYNINVPLDNLCSSGLEASAEQEVSAEDETLAEYMGQTSDHESQVTFTHRINFPKKACPCASSAQVLQELLSRIEMLEREVSVLRDQCNANCCQESAATGQLDYIPHCSGHGNFSFESCGCICNEGWFGKNCSEPYCPLGCSSRGVCVDGQCICDSEYSGDDCSELRCPTDCSSRGLCVDGECVCEEPYTGEDCRELRCPGDCSGKGRCANGTCLCEEGYVGEDCGQRQCLNACSGRGQCEEGLCVCEEGYQGPDCSAVAPPEDLRVAGISDRSIELEWDGPMAVTEYVISYQPTALGGLQLQQRVPGDWSGVTITELEPGLTYNISVYAVISNILSLPITAKVATHLSTPQGLQFKTITETTVEVQWEPFSFSFDGWEISFIPKNNEGGVIAQVPSDVTSFNQTGLKPGEEYIVNVVALKEQARSPPTSASVSTVIDGPTQILVRDVSDTVAFVEWIPPRAKVDFILLKYGLVGGEGGRTTFRLQPPLSQYSVQALRPGSRYEVSVSAVRGTNESDSATTQFTTEIDAPKNLRVGSRTATSLDLEWDNSEAEVQEYKVVYSTLAGEQYHEVLVPRGIGPTTRATLTDLVPGTEYGVGISAVMNSQQSVPATMNARTELDSPRDLMVTASSETSISLIWTKASGPIDHYRITFTPSSGIASEVTVPKDRTSYTLTDLEPGAEYIISVTAERGRQQSLESTVDAFTGIDPPKDITISNVTKDSVMVSWSPPVASFDYYRVSYRPTQVGRLDSSVVPNTVTEFTITRLNPATEYEISLNSVRGREESERICTLVHTAMDNPVDLIATNITPTEALLQWKAPVGEVENYVIVLTHFAVAGETILVDGVSEEFRLVDLLPSTHYTATMYATNGPLTSGTISTNFSTLLDPPANLTASEVTRQSALISWQPPRAEIENYVLTYKSTDGSRKELIVDAEDTWIRLEGLLENTDYTVLLQAAQDTTWSSITSTAFTTGGRVFPHPQDCAQHLMNGDTLSGVYPIFLNGELSQKLQVYCDMTTDGGGWIVFQRRQNGQTDFFRKWADYRVGFGNVEDEFWLGLDNIHRITSQGRYELRVDMRDGQEAAFASYDRFSVEDSRNLYKLRIGSYNGTAGDSLSYHQGRPFSTEDRDNDVAVTNCAMSYKGAWWYKNCHRTNLNGKYGESRHSQGINWYHWKGHEFSIPFVEMKMRPYNHRLMAGRKRQSLQF

SEQ ID NO: 66724 - protein, 1358 aa, Homo sapiens; identical to SEQ ID NO: 66722

SEQ ID NO: 66725 - protein, 177 aa, Homo sapiens
  MOD_RES (1)..(1): Any amino acid
XINFPKKACPCASSAQVLQELLSRIEMLEREVSVLRDQCNANCCQESAATVAPPEDLRVAGISDRSIELEWDGPMAVTEYVISYQPTALGGLQLQQRVPGDWSGVTITELEPGLTYNISVYAVISNILSLPITAKVATHLSTPQGLQFKTITETTVEVQWEPFSFSFDGWEISFIPK

SEQ ID NO: 66726 - protein, 4222 aa, Homo sapiens
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYAGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 66727 - protein, 2149 aa, Homo sapiens
  MOD_RES (1)..(1): Any amino acid
XAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVTGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDIQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQTQEILLPGGITSHQLLGLFPSTSYNARLQAMWGQSLLPPVSTSFTTGGLRIPFPRDCGEEMQNGAGASRTSTIFLNGNRERPLIVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 66728 - protein, 8 aa, Homo sapiens
MMPAQYAL

SEQ ID NO: 66729 - protein, 8 aa, Homo sapiens
MMPAQYAL

SEQ ID NO: 66730 - protein, 3296 aa, Homo sapiens
  MOD_RES (1)..(1): Any amino acid
XSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPQAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPGPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRVEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 66731 - protein, 4222 aa, Homo sapiens
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDIQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQTQEILLPGGITSHQLLGLFPSTSYNARLQAMWGQSLLPPVSTSFTTGGLRIPFPRDCGEEMQNGAGASRTSTIFLNGNRERPLIVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 66732 - protein, 8 aa, Homo sapiens
MMPAQYAL

SEQ ID NO: 66733 - protein, 634 aa, Homo sapiens
  MOD_RES (1)..(1): Any amino acid
XSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVT

SEQ ID NO: 66734 - protein, 8 aa, Homo sapiens
MMPAQYAL

SEQ ID NO: 66735 - protein, 4222 aa, Homo sapiens
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPHPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTIPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDIQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQTQEILLPGGITSHQLLGLFPSTSYNARLQATWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 66736 - protein, 8 aa, Homo sapiens
MMPAQYAL

SEQ ID NO: 66737 - protein, 2280 aa, Homo sapiens
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLT

SEQ ID NO: 66738 - protein, 673 aa, Homo sapiens
MRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDIQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQTQEILLPGGITSHQLLGLFPSTSYNARLQAMWGQSLLPPVSTSFTTGGLRIPFPRDCGEEMQNGAGASRTSTIFLNGNRERPLIVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 66739 - protein, 217 aa, Homo sapiens
APGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVT

SEQ ID NO: 66740 - protein, 4242 aa, Homo sapiens
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTEDEAETTQAVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDIQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQTQEILLPGGITSHQLLGLFPSTSYNARLQAMWGQSLLPPVSTSFTTGGLRIPFPRDCGEEMQNGAGASRTSTIFLNGNRERPLIVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 66741 - protein, 4242 aa, Homo sapiens
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYAGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTEDEAETTQAVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 66742 - protein, 280 aa, Homo sapiens
MVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVT

SEQ ID NO: 66743 - protein, 4242 aa, Homo sapiens
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPHPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTEDEAETTQAVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTIPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDIQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQTQEILLPGGITSHQLLGLFPSTSYNARLQATWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 66744 - protein, 673 aa, Homo sapiens
MRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 66745 - protein, 217 aa, Homo sapiens; identical to SEQ ID NO: 66739

SEQ ID NO: 66746 - protein, 313 aa, Homo sapiens
TEPGTEAPGPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVT

SEQ ID NO: 66747 - protein, 313 aa, Homo sapiens
MTPEPPIKPRLGELTMTDATPDSLSLSWTVPEGQFDHFLVQYRNGDGQPKAVRVPGHEDGVTISGLEPDHKYKMNLYGFHGGQRVGPISVTGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTAPEDEEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVT

SEQ ID NO: 66748 - protein, 426 aa, Homo sapiens
AGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLW

SEQ ID NO: 66749 - protein, 865 aa, Homo sapiens
LYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLA

SEQ ID NO: 66750 - protein, 1735 aa, Homo sapiens
MSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGVTRRRIQPEEDEGKVVVRLSEEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGWRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFVNSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 66751 - protein, 416 aa, Homo sapiens
MVPFQQRKDCVLEGSTRVTPSVQPHLQPIRNMSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEDGNKQNTNSQSIGSISGGLEDQYTWPDTHWPSQS

SEQ ID NO: 66752 - protein, 103 aa, Homo sapiens
MSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNA

SEQ ID NO: 66753 - protein, 1714 aa, Homo sapiens
MSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGWRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFVNSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 66754 - protein, 61 aa, Homo sapiens
MSVSRTMEDSCELDLVYVTERIIAVSFPSTANEENFRSNLREVAQMLKSKHGGNYLLFNLS

SEQ ID NO: 66755 - protein, 24 aa, Homo sapiens
MSVSRTMEDSCELDLVYVTERIIA

SEQ ID NO: 66756 - protein, 1445 aa, Homo sapiens
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMVKCYHKKYRSATRDVIFRLQFHTGAVQGYGLVFGKEDLDNASKDDRFPDYGKVELVFSATPEKIQGSEHLYNDHGVIVDYNTTDPLIRWDSYENLSADGEVLHTQGPVDGSLYAKVRKKSSSDPGIPGGPQAIPATNSPDHSDHTLSVSSDSGHSTASARTDKTEERLAPGTRRGLSAQEKAELDQLLSGFGLEDPGSSLKEMTDARSKYSGTRHVVPAQVHVNGDAALKDRETDILDDEMPHHDLHSVDSLGTLSSSEGPQSAHLGPFTCHKSSQNSLLSDGFGSNVGEDPQGTLVPDLGLGMDGPYERERTFGSREPKQPQPLLRKPSVSAQMQAYGQSSYSTQTWVRQQQMVVAHQYSFAPDGEARLVSRCPADNPGLVQAQPRVPLTPTRGTSSRVAVQRGVGSGPHPPDTQQPSPSKAFKPRFPGDQVVNGAGPELSTGPSPGSPTLDIDQSIEQLNRLILELDPTFEPIPTHMNALGSQANGSVSPDSVGGGLRASSRLPDTGEGPSRATGRQGSSAEQPLGGRLRKLSLGQYDNDAGGQLPFSKCAWGKAGVDYAPNLPPFPSPADVKETMTPGYPQDLDIIDGRILSSKESMCSTPAFPVSPETPYVKTALRHPPFSPPEPPLSSPASQHKGGREPRSCPETLTHAVGMSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASEAASPLPDSPGDKLVIVKFVQDTSKFWYKADISREQAIAMLKDKEPGSFIVRDSHSFRGAYGLAMKVATPPPSVLQLNKKAGDLANELVRHFLIECTPKGVRLKGCSNEPYFGSLTALVCQHSITPLALPCKLLIPERDPLEEIAESSPQTAANSAAELLKQGAACNVWYLNSVEMESLTGHQAIQKALSITLVQEPPPVSTVVHFKVSAQGITLTDNQRKLFFRRHYPVNSVIFCALDPQDRKWIKDGPSSKVFGFVARKQGSATDNVCHLFAEHDPEQPASAIVNFVSKVMIGSPKKV

SEQ ID NO: 66757 - protein, 1205 aa, Homo sapiens
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMMPHHDLHSVDSLGTLSSSEGPQSAHLGPFTCHKSSQNSLLSDGFGSNVGEDPQGTLVPDLGLGMDGPYERERTFGSREPKQPQPLLRKPSVSAQMQAYGQSSYSTQTWVRQQQMVVAHQYSFAPDGEARLVSRCPADNPGLVQAQPRVPLTPTRGTSSRVAVQRGVGSGPHPPDTQQPSPSKAFKPRFPGDQVVNGAGPELSTGPSPGSPTLDIDQSIEQLNRLILELDPTFEPIPTHMNALGSQANGSVSPDSVGGGLRASSRLPDTGEGPSRATGRQGSSAEQPLGGRLRKLSLGQYDNDAGGQLPFSKCAWGKAGVDYAPNLPPFPSPADVKETMTPGYPQDLDIIDGRILSSKESMCSTPAFPVSPETPYVKTALRHPPFSPPEPPLSSPASQHKGGREPRSCPETLTHAVGMSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASEAASPLPDSPGDKLVIVKFVQDTSKFWYKADISREQAIAMLKDKEPGSFIVRDSHSFRGAYGLAMKVATPPPSVLQLNKKAGDLANELVRHFLIECTPKGVRLKGCSNEPYFGSLTALVCQHSITPLALPCKLLIPERDPLEEIAESSPQTAANSAAELLKQGAACNVWYLNSVEMESLTGHQAIQKALSITLVQEPPPVSTVVHFKVSAQGITLTDNQRKLFFRRHYPVNSVIFCALDPQDRKWIKDGPSSKVFGFVARKQGSATDNVCHLFAEHDPEQPASAIVNFVSKVMIGSPKKV

SEQ ID NO: 66758 - protein, 1445 aa, Homo sapiens; identical to SEQ ID NO: 66756

SEQ ID NO: 66759 - protein, 108 aa, Homo sapiens
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCR

SEQ ID NO: 66760 - protein, 138 aa, Homo sapiens
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRF

SEQ ID NO: 66761 - protein, 250 aa, Homo sapiens
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMVMNYNIANI

SEQ ID NO: 66762 - protein, 250 aa, Homo sapiens; identical to SEQ ID NO: 66761

SEQ ID NO: 66763 - protein, 1271 aa, Homo sapiens
SQALNERMNWLCRNQDPNPPPQPEELTSSLHAFKNKAFKKSKVCGVCKQIIDGQGISCRACKYSCHKKCEAKVVIPCGVQVRLEQAPGSSTLSSSLCRDKPLRPVILSPTMEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMVKCYHKKYRSATRDVIFRLQFHTGAVQGYGLVFGKEDLDNASKDDRFPDYGKVELVFSATPEKIQGSEHLYNDHGVIVDYNTTDPLIRWDSYENLSADGEVLHTQGPVDGSLYAKVRKKSSSDPGIPGGPQAIPATNSPDHSDHTLSVSSDSGHSTASARTDKTEERLAPGTRRGLSAQEKAELDQLLSGFGLEDPGSSLKEMTDARSKYSGTRHVVPAQVHVNGDAALKDRETDILDDEMPHHDLHSVDSLGTLSSSEGPQSAHLGPFTCHKSSQNSLLSDGFGSNVGEDPQGTLVPDLGLGMDGPYERERTFGSREPKQPQPLLRKPSVSAQMQAYGQSSYSTQTWVRQQQMVVAHQYSFAPDGEARLVSRCPADNPGLVQAQPRVPLTPTRGTSSRVAVQRGVGSGPHPPDTQQPSPSKAFKPRFPGDQVVNGAGPELSTGPSPGSPTLDIDQSIEQLNRLILELDPTFEPIPTHMNALGSQANGSVSPDSVGGGLRASSRLPDTGEGPSRATGRQGSSAEQPLGGRLRKLSLGQYDNDAGGQLPFSKCAWGKAGVDYAPNLPPFPSPADVKETMTPGYPQDLDIIDGRILSSKESMCSTPAFPVSPETPYVKTALRHPPFSPPEPPLSSPASQHKGGREPRSCPETLTHAVGMSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASEAPTFYQTSKPDIPGP

SEQ ID NO: 66764 - protein, 919 aa, Homo sapiens
MDGPYERERTFGSREPKQPQPLLRKPSVSAQMQAYGQSSYSTQTWVRQQQMVVAHQYSFAPDGEARLVSRCPADNPGLVQAQPRVPLTPTRGTSSRVAVQRGVGSGPHPPDTQQPSPSKAFKPRFPGDQVVNGAGPELSTGPSPGSPTLDIDQSIEQLNRLILELDPTFEPIPTHMNALGSQANGSVSPDSVGGGLRASSRLPDTGEGPSRATGRQGSSAEQPLGGRLRKLSLGQYDNDAGGQLPFSKCAWGKAGVDYAPNLPPFPSPADVKETMTPGYPQDLDIIDGRILSSKESMCSTPAFPVSPETPYVKTALRHPPFSPPEPPLSSPASQHKGGREPRSCPETLTHAVGMSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASEAASPLPDSPGDKLVIVKFVQDTSKFWYKADISREQAIAMLKDKEPGSFIVRDSHSFRGAYGLAMKVATPPPSVLQLNKKAGDLANELVRHFLIECTPKGVRLKGCSNEPYFGSLTALVCQHSITPLALPCKLLIPERDPLEEIAESSPQTAANSAAELLKQGAACNVWYLNSVEMESLTGHQAIQKALSITLVQEPPPVSTVVHFKVSAQGITLTDNQRKLFFRRHYPVNSVIFCALDPQDRKWIKDGPSSKVFGFVARKQGSATDNVCHLFAEHDPEQPARESQRHRGARDGPHEAMPRRHSGSPANVLFELIGQV

SEQ ID NO: 66765 - protein, 715 aa, Homo sapiens
MSQVMSSPLLAGGHAVSLAPCDEPRRTLHPAPSPSLPPQCSYYTTEGWGAQALMAPVPCMGPPGRLQQAPQVEAKATCFLPSPGEKALGTPEDLDSYIDFSLESLNQMILELDPTFQLLPPGTGGSQAELAQSTMSMRKKEESEALDIKYIEVTSARSRCHDGPQHCSSPSVTPPFGSLRSGGLLLSRDVPRETRSSSESLIFSGNQGRGHQRPLPPSEGLSPRPPNSPSISIPCMGSKASSPHGLGSPLVASPRLEKRLGGLAPQRGSRISVLSASPVSDVSYMFGSSQSLLHSSNSSHQSSSRSLESPANSSSSLHSLGSVSLCTRPSDFQAPRNPTLTMGQPRTPHSPPLAKEHASSCPPSITNSMVDIPIVLINGCPEPGSSPPQRTPGHQNSVQPGAASPSNPCPATRSNSQTLSDAPFTTCPEGPARDMQPTMKFVMDTSKYWFKPNITREQAIELLRKEEPGAFVIRDSSSYRGSFGLALKVQEVPASAQSRPGEDSNDLIRHFLIESSAKGVHLKGADEEPYFGSLSAFVCQHSIMALALPCKLTIPQRELGGADGASDSTDSPASCQKKSAGCHTLYLSSVSVETLTGALAVQKAISTTFERDILPTPTVVHFKVTEQGITLTDVQRKVFFRRHYPLTTLRFCGMDPEQRKWQKYCKPSWIFGFVAKSQTEPQENVCHLFAEYDMVQPASQVIGLVTALLQDAERM

SEQ ID NO: 66766 - protein, 715 aa, Homo sapiens; identical to SEQ ID NO: 66765

SEQ ID NO: 66767 - protein, 128 aa, Homo sapiens
MRPVPVRGVHSLHPRPFGGPVSLPWLRTGRCRWGLGLYRQPSLLPEEICGVFFRRHYPLTTLRFCGMDPEQRKWQKYCKPSWIFGFVAKSQTEPQENVCHLFAEYDMVQPASQVIGLVTALLQDAERM

SEQ ID NO: 66768 - protein, 1409 aa, Homo sapiens
MKSSGPVERLLRALGRRDSSRAASRPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 66769 - protein, 1419 aa, Homo sapiens
MDGGGVCVGRGDLLSSPQALGQLLRKESRPRRAMKPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 66770 - protein, 1285 aa, Homo sapiens
MERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 66771 - protein, 781 aa, Homo sapiens
MKSSGPVERLLRALGRRDSSRAASRPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 66772 - protein, 1399 aa, Homo sapiens
MKSSGPVERLLRALGRRDSSRAASRPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPASLYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 66773 - protein, 188 aa, Homo sapiens
MDCRKMARFSYSVIWIMAISKVFELGLVAGLGHQEFARPSRGYLAFRDDSIWPQEEPAIRPRSSQRVPPMGIQHSKELNRTCCLNGGTCMLGSFCACPPSFYGRNCEHDVRKENCGSVPHDTWLPKKCSLCKCWHGQLRCFPQAFLPGCDGLVMDEHLVASRTPELPPSARTTTFMLVGICLSIQSYY

SEQ ID NO: 66774 - protein, 172 aa, Homo sapiens
MAISKVFELGLVAGLGHQEFARPSRGYLAFRDDSIWPQEEPAIRPRSSQRVPPMGIQHSKELNRTCCLNGGTCMLGSFCACPPSFYGRNCEHDVRKENCGSVPHDTWLPKKCSLCKCWHGQLRCFPQAFLPGCDGLVMDEHLVASRTPELPPSARTTTFMLVGICLSIQSYY

SEQ ID NO: 66775 - protein, 214 aa, Homo sapiens
MGAAHSASEEVRELEGKTGFSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRFLFHMYDSDSDGRITLEEYRNVVEELLSGNPHIEKESARSIADGAMMEAASVCMGQMEPDQVYEGITFEDFLKIWQGIDIETKMHVRFLNMETMALCH

SEQ ID NO: 66776 - protein, 267 aa, Homo sapiens
MRPRSGPTRNPRLRAFAGVPTRGRTRGQSRRCAAEASAGPERDARPGAPAAGTMGAAHSASEEVRELEGKTGFSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRFLFHMYDSDSDGRITLEEYRNVVEELLSGNPHIEKESARSIADGAMMEAASVCMGQMEPDQVYEGITFEDFLKIWQGIDIETKMHVRFLNMETMALCH

SEQ ID NO: 66777 - protein, 187 aa, Homo sapiens
MGAAHSASEEVRELEGKTGFSSDQIEQLHRRFKQLSGDQPTIRNLRKGPSGLADEINFEDFLTIMSYFRPIDTTMDEEQVELSRKEKLRFLFHMYDSDSDGRITLEEYRNVVEELLSGNPHIEKESARSIADGAMMEAASVCMGQMEPDQVYEGITFEDFLKIWQGIDIETKMHVRFLNMETMALCH

SEQ ID NO: 66778 - protein, 421 aa, Homo sapiens
LNLEVKFKKMGLGHEQGFGAPCLKCKEKCEGFELHFWRKICRNCKCGQEEHDVLLSNEEDRKVGKLFEDTKYTTLIAKLKSDGIPMYKRNVMILTNPVAAKKNVSINTVTYEWAPPVQNQALARQYMQMLPKEKQPVAGSEGAQYRKKQLAKQLPAHDQDPSKCHELSPREVKEMEQFVKKYKSEALGVGDVKLPCEMDAQGPKQMNIPGGDRSTPAAVGAMEDKSAEHKRTQYSCYCCKLSMKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVCQGCHNAIDPEVQRVTYNNFSWHASTECFLCSCCSKCLIGQKFMPVEGMVFCSVECKKRMS

SEQ ID NO: 66779 - protein, 421 aa, Homo sapiens
MDLENKVKKMGLGHEQGFGAPCLKCKEKCEGFELHFWRKICRNCKCGQEEHDVLLSNEEDRKVGKLFEDTKYTTLIAKLKSDGIPMYKRNVMILTNPVAAKKNVSINTVTYEWAPPVQNQALARQYMQMLPKEKQPVAGSEGAQYRKKQLAKQLPAHDQDPSKCHELSPREVKEMEQFVKKYKSEALGVGDVKLPCEMDAQGPKQMNIPGGDRSTPAAVGAMEDKSAEHKRTQYSCYCCKLSMKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVCQGCHNAIDPEVQRVTYNNFSWHASTECFLCSCCSKCLIGQKFMPVEGMVFCSVECKKRMS

SEQ ID NO: 66780 - protein, 412 aa, Homo sapiens
MGLGHEQGFGAPCLKCKEKCEGFELHFWRKICRNCKCGQEEHDVLLSNEEDRKVGKLFEDTKYTTLIAKLKSDGIPMYKRNVMILTNPVAAKKNVSINTVTYEWAPPVQNQALARQYMQMLPKEKQPVAGSEGAQYRKKQLAKQLPAHDQDPSKCHELSPREVKEMEQFVKKYKSEALGVGDVKLPCEMDAQGPKQMNIPGGDRSTPAAVGAMEDKSAEHKRTQYSCYCCKLSMKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVCQGCHNAIDPEVQRVTYNNFSWHASTECFLCSCCSKCLIGQKFMPVEGMVFCSVECKKRMS

SEQ ID NO: 66781 - protein, 179 aa, Homo sapiens
MKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVCQGCHNAIDPEVQRVTYNNFSWHASTECFLCSCCSKCLIGQKFMPVEGMVFCSVECKKRMS

SEQ ID NO: 66782 - protein, 267 aa, Homo sapiens
MGARQIQTSSSQTSPEEAMGTPRIQHLLILLVLGASLLTSGLELYCQKGLSMTVEADPANMFNWTTEEVETCDKGALCQETILIIKAGTETAILATKGCIPEGEEAITIVQHSSPPGLIVTSYSNYCEDSFCNDKDSLSQFWEFSETTASTVSTTLHCPTCVALGTCFSAPSLPCPNGTTRCYQGKLEITGGGIESSVEVKGCTAMIGCRLMSGILAVGPMFVREACPHQLLTQPRKTENGATCLPIPVWGLQLLLPLLLPSFIHFS

SEQ ID NO: 66783 - protein, 262 aa, Homo sapiens
IQTSSSQTSPEEAMGTPRIQHLLILLVLGASLLTSGLELYCQKGLSMTVEADPANMFNWTTEEVETCDKGALCQETILIIKAGTETAILATKGCIPEGEEAITIVQHSSPPGLIVTSYSNYCEDSFCNDKDSLSQFWEFSETTASTVSTTLHCPTCVALGTCFSAPSLPCPNGTTRCYQGKLEITGGGIESSVEVKGCTAMIGCRLMSGILAVGPMFVREACPHQLLTQPRKTENGATCLPIPVWGLQLLLPLLLPSFIHFS

SEQ ID NO: 66784 - protein, 249 aa, Homo sapiens
MGTPRIQHLLILLVLGASLLTSGLELYCQKGLSMTVEADPANMFNWTTEEVETCDKGALCQETILIIKAGTETAILATKGCIPEGEEAITIVQHSSPPGLIVTSYSNYCEDSFCNDKDSLSQFWEFSETTASTVSTTLHCPTCVALGTCFSAPSLPCPNGTTRCYQGKLEITGGGIESSVEVKGCTAMIGCRLMSGILAVGPMFVREACPHQLLTQPRKTENGATCLPIPVWGLQLLLPLLLPSFIHFS

SEQ ID NO: 66785 - protein, 267 aa, Homo sapiens; identical to SEQ ID NO: 66782

SEQ ID NO: 66786 - protein, 940 aa, Homo sapiens
MISAHCNLRLLCSSDSSASASQVAGTTEVVENLVTNDNSPNIPEAIDRLFSDIANINRESMAEITDIQIEEMAVNLWNWALTIGGGWLVNEEQKIRLHYVACKLLSMCEASFASEQSIQRLIMMNMRIGKEWLDAGNFLIADECFQAAVASLEQLYVKLIQRSSPEADLTMEKITVESDHFRVLSYQAESAVAQGDFQRASMCVLQCKDMLMRLPQMTSSLHHLCYNFGVETQKNNKYEESSFWLSQSYDIGKMDKKSTGPEMLAKVLRLLATNYLDWDDTKYYDKALNAVNLANKEHLSSPGLFLKMKILLKGETSNEELLEAVMEILHLDMPLDFCLNIAKLLMDHERESVGFHFLTIIHERFKSSENIGKVLILHTDMLLQRKEELLAKEKIEEIFLAHQTGRQLTAESMNWLHNILWRQAASSFEVQNYTDALQWYYYSLRFYSTDEMDLDFTKLQRNMACCYLNLQQLDKAKEAVAEAERHDPRNVFTQFYIFKIAVIEGNSERALQAIITLENILTDEESEDNDLVAERGSPTMLLSLAAQFALENGQQIVAEKALEYLAQHSEDQEQVLTAVKCLLRFLLPKIAEMPESEDKKKEMDRLLTCLNRAFVKLSQPFGEEALSLESRANEAQWFRKTAWNLAVQCDKDPVMMREFFILSYKMSQFCPSDQVILIARKTCLLMAVAVDLEQGRKASTAFEQTMFLSRALEEIQTCNDIHNFLKQTGTFSNDSCEKLLLLYEFEVRAKLNDPLLESFLESVWELPHLETKTFETIAIIAMEKPAHYPLIALKALKKALLLYKKEEPIDISQYSKCMHNLVNLSVPDGASNVELCPLEEVWGYFEDALSHISRTKDYPEMEILWLMVKSWNTGVLMFSRSKYASAEKWCGLALRFLNHLTSFKESYETQMNMLYSQLVEALSNNKGPVFHEHGYWSKSD

SEQ ID NO: 66787 - protein, 615 aa, Homo sapiens
MEILHLDMPLDFCLNIAKLLMDHERESVGFHFLTIIHERFKSSENIGKVLILHTDMLLQRKEELLAKEKIEEIFLAHQTGRQLTAESMNWLHNILWRQAASSFEVQNYTDALQWYYYSLRFYSTDEMDLDFTKLQRNMACCYLNLQQLDKAKEAVAEAERHDPRNVFTQFYIFKIAVIEGNSERALQAIITLENILTDEESEDNDLVAERGSPTMLLSLAAQFALENGQQIVAEKALEYLAQHSEDQEQVLTAVKCLLRFLLPKIAEMPESEDKKKEMDRLLTCLNRAFVKLSQPFGEEALSLESRANEAQWFRKTAWNLAVQCDKDPVMMREFFILSYKMSQFCPSDQVILIARKTCLLMAVAVDLEQGRKASTAFEQTMFLSRALEEIQTCNDIHNFLKQTGTFSNDSCEKLLLLYEFEVRAKLNDPLLESFLESVWELPHLETKTFETIAIIAMEKPAHYPLIALKALKKALLLYKKEEPIDISQYSKCMHNLVNLSVPDGASNVELCPLEEVWGYFEDALSHISRTKDYPEMEILWLMVKSWNTGVLMFSRSKYASAEKWCGLALRFLNHLTSFKESYETQMNMLYSQLVEALSNNKGPVFHEHGYWSKSD

SEQ ID NO: 66788 - protein, 925 aa, Homo sapiens
MDNDDFFSMDFKEVVENLVTNDNSPNIPEAIDRLFSDIANINRESMAEITDIQIEEMAVNLWNWALTIGGGWLVNEEQKIRLHYVACKLLSMCEASFASEQSIQRLIMMNMRIGKEWLDAGNFLIADECFQAAVASLEQLYVKLIQRSSPEADLTMEKITVESDHFRVLSYQAESAVAQGDFQRASMCVLQCKDMLMRLPQMTSSLHHLCYNFGVETQKNNKYEESSFWLSQSYDIGKMDKKSTGPEMLAKVLRLLATNYLDWDDTKYYDKALNAVNLANKEHLSSPGLFLKMKILLKGETSNEELLEAVMEILHLDMPLDFCLNIAKLLMDHERESVGFHFLTIIHERFKSSENIGKVLILHTDMLLQRKEELLAKEKIEEIFLAHQTGRQLTAESMNWLHNILWRQAASSFEVQNYTDALQWYYYSLRFYSTDEMDLDFTKLQRNMACCYLNLQQLDKAKEAVAEAERHDPRNVFTQFYIFKIAVIEGNSERALQAIITLENILTDEESEDNDLVAERGSPTMLLSLAAQFALENGQQIVAEKALEYLAQHSEDQEQVLTAVKCLLRFLLPKIAEMPESEDKKKEMDRLLTCLNRAFVKLSQPFGEEALSLESRANEAQWFRKTAWNLAVQCDKDPVMMREFFILSYKMSQFCPSDQVILIARKTCLLMAVAVDLEQGRKASTAFEQTMFLSRALEEIQTCNDIHNFLKQTGTFSNDSCEKLLLLYEFEVRAKLNDPLLESFLESVWELPHLETKTFETIAIIAMEKPAHYPLIALKALKKALLLYKKEEPIDISQYSKCMHNLVNLSVPDGASNVELCPLEEVWGYFEDALSHISRTKDYPEMEILWLMVKSWNTGVLMFSRSKYASAEKWCGLALRFLNHLTSFKESYETQMNMLYSQLVEALSNNKGPVFHEHGYWSKSD

SEQ ID NO: 66789 - protein, 940 aa, Homo sapiens; identical to SEQ ID NO: 66786

SEQ ID NO: 66790 - protein, 123 aa, Homo sapiens
MMANHLVKPDNRNCKRPRELESPVPDSPQLSSLGKSDSSFSEISGLFYKDEALEKDLNDVSKEINLMLSTYAKLLSERAAVDASYIDEIDELFKEANAIENFLIQKREFLRQRFTVIANTLHR

SEQ ID NO: 66791 - protein, 123 aa, Homo sapiens; identical to SEQ ID NO: 66790

SEQ ID NO: 66792 - protein, 352 aa, Homo sapiens
MALRPEDPSSGFRHSNVVAFINEKMARHTKGPEFYLENISLSWEKVEDKLRAILEDSEVPSEVKEACTWGSLALGVRFAHRQAQLQRHRVRWLHGFAKLHKSAAQALASDLKKLREQQETERKEAASRLRMAQTSLVEVQKERDKELVSPHEWEQGAGWPGLATAGGVCTEGAAEEEEEAAVAAAGAAGGKGAEEEQRGCWRLWLPLWRPWLPLWRLGLPPWRPSSPTWRPGLPPWRPQRSWRESSCSSLEMLIRKSTPIGGRRREISGRSKQPHLISLEPRTPGPEPHQNLFLSSSLPHTHTHTQALFPPSQTYPLYPLHKQQSQHQFRLSCLPTGRPLILACGLMGGPTE

SEQ ID NO: 66793 - protein, 352 aa, Homo sapiens; identical to SEQ ID NO: 66792

SEQ ID NO: 66794 - protein, 409 aa, Homo sapiens
MALRPEDPSSGFRHSNVVAFINEKMARHTKGPEFYLENISLSWEKVEDKLRAILEDSEVPSEVKEACTWGSLALGVRFAHRQAQLQRHRVRWLHGFAKLHKSAAQALASDLKKLREQQETERKEAASRLRMAQTSLVEVQKERDKELVSPHEWEQGAGWPGLATAGGVCTEGAAEEEEEAAVAAAGAAGGKGAEEEQRDVEVVAAPVEAMAPPVEAGAAPMETQFPHVEARAASMETTEKLERILLQLLGDADQEKYTYWGQKEGDLRSVETATSYFSGTTNPWSRASSEPLPVQLPASYSYSYSSPFSSFSDIPTISPPQATVTAPVPPQLPSDWEAFDTSLWSDGGPHRIDHQEHPRDRRYSEPHQQRPPVYRRPGDWDCPWCNAVNFSRRDTCFDCGKGIWLQKPH

SEQ ID NO: 66795 - protein, 312 aa, Homo sapiens
MALRPEDPSSGFRHGNVVAFIIEKMARHTKGPEFYFENISLSWEEVEDKLRAILEDSEVPSEVKEACTWGSLALGVRFAHRQGQLQNRRVQWLQGFAKLHRSAALVLASNLTELKEQQEMECNEATFQLQLTETSLAEVQRERDMLRWKLFHAELAPPQGQGQATVFPGLATAGGDWTEGAGEQEKEAVAAAGAAGGKGEERYAEAGPAPAEVLQGLGGGFRQPLGAIVAGKLHLCGAEGERSQVSTNSHVCLLWAWVHSLTGASSCPAPYLIHILIPMPFVRLLSHTQYTPFTSKGHRTGSNSDAFQLGGL

SEQ ID NO: 66796 - protein, 1497 aa, Homo sapiens
MSRAVRLPVPCPVQLGTLRNDSLEAQLHEYVKQGNYVKVKKILKKGIYVDAVNSLGQTALFVAALLGLRKFVDVLVDYGSDPNHRCFDGSTPVHAAAFSGNQWILSKLLDAGGDLRLHDERGQNPKTWALTAGKERSTQIVEFMQRCASHMQAIIQGFSYDLLKKIDSPQRLVYSPSWCGGLVQGNPNGSPNRLLKAGVISAQNIYSFGFGKAMPWFQFYLTGATQMAYLGSLPVIGEKEVIQADDEPTFSFFSGPYMVMTNLVWNGSRVTVKELNLPTHPHCSRLRLADLLIAEQEHSSKLRHPYLLQLMAVCLSQDLEKTRLVYERITIGTLFSVLHERRSQFPVLHMEVIVHLLLQISDALRYLHFQGFIHRSLSSYAVHIISPGEARLTNLEYMLESEDRGVQRDLTRVPLPTQLYNWAAPEVILQKAATVKSDIYSFSMIMQEILTDDIPWKGLDGSVVKKAVVSGNYLEADVRLPKPYYDIVKSGIHVKQKDRTMNLQDIRYILKNDLKDFTGAQRTQPTESPRVQRYGLHPDVNVYLGLTSEHPRETPDMEIIELKEMGSQPHSPRVHSLFTEGTLDPQAPDPCLMARETQNQDAPCPAPFMAEEASSPSTGQPSLCSFEINEIYSGCLILEDDIEEPPGAASSLEADGPNQVDELKSMEEELDKMEREACCFGSEDESSSKAETEYSFDDWDWQNGSLSSLSLPESTREAKSNLNNMSTTEEYLISKCVLDLKIMQTIMHENDDRLRNIEQILDEVEMKQKEQEERMSLWATSREFTNAYKLPLAVGPPSLNYIPPVLQLSGGQKPDTSGNYPTLPRFPRMLPTLCDPGKQNTDEQFQCTQGAKDSLETSRIQNTSSQGRPRESTAQAKATQFNSALFTLSSHRQGPSASPSCHWDSTRMSVEPVSSEIYNAESRNKDDGKVHLKWKMEVKEMAKKAATGQLTVPPWHPQSSLTLESEAENEPDALLQPPIRSPENTDWQRVIEYHRENDEPRGNGKFDKTGNNDCDSDQHGRQPRLGSFTSIRHPSPRQKEQPEHSEAFQASSDTLVAVEKSYSHQSMQSTCSPESSEDITDEFLTPDGEYFYSSTAQENLALETSSPIEEDFEGIQGAFAQPQVSGEEKFQMRKILGKNAEILPRSQFQPVRSTEDEQEETSKESPKELKEKDISLTDIQDLSSISYEPDSSFKEASCKTPKINHAPTSVSTPLSPGSVSSAASQYKDCLESITFQVKTEFASCWNSQEFIQTLSDDFISVRERAKKLDSLLTSSETPPSRLTGLKRLSSFIGAGSPSLVKACDSSPPHATQRRSLPKVEAFSQHHIDELPPPSQELLDDIELLKQQQGSSTVLHENTASDGGGTANDQRHLEEQETDSKKEDSSMLLSKETEDLGEDTERAHSTLDEDLERWLQPPEESVELQDLPKGSERETNIKDQKVGEEKRKREDSITPERRKSEGVLGTSEEDELKSCFWKRLGWSESSRIIVLDQSDLSD

SEQ ID NO: 66797 - protein, 1451 aa, Homo sapiens
MSRAVRLPVPCPVQLGTLRNDSLEAQLHEYVKQGNYVKVKKILKKGIYVDAVNSLGQTALFVAALLGLRKFVDVLVDYGSDPNHRCFDGSTPVHAAAFSGNQWILSKLLDAGGDLRLHDERGQNPKTWALTAGKERSTQIVEFMQRCASHMQAIIQGFSYDLLKKIDSPQRLVYSPSWCGGLVQGNPNGSPNRLLKAGVISAQNIYSFGFGKFYLTGATQMAYLGSLPVIGEKEVIQADDEPTFSFFSGPYMVMTNLVWNGSRVTVKELNLPTHPHCSRLRLADLLIAEQEHSSKLRHPYLLQLMAVCLSQDLEKTRLVYERITIGTLFSVLHERRSQFPVLHMEVIVHLLLQISDALRYLHFQGFIHRSLSSYAVHIISPGEARLTNLEYMLESEDRGVQRDLTRVPLPTQLYNWAAPEVILQKAATVKSDIYSFSMIMQEILTDDIPWKGLDGSVVKKAVVSGNYLEADVRLPKPYYDIVKSGIHVKQKDRTMNLQDIRYILKNDLKDFTGAQRTQPTESPRVQRYGLHPDVNVYLGLTSEHPRETPDMEIIELKEMGSQPHSPRVHSLFTEGTLDPQAPDPCLMARETQNQDAPCPAPFMAEEASSPSTGQPSLCSFEINEIYSGCLILEDDIEEPPGAASSLEADGPNQVDELKSMEEELDKMEREACCFGSEDESSSKAETEYSFDDWDWQNGSLSSLSLPESTREAKSNLNNMSTTEEYLISKCVLDLKIMQTIMHENDDRLRNIEQILDEVEMKQKEQEERMSLWATSREFTNAYKLPLAVGPPSLNYIPPVLQLSGGQKPDTSGNYPTLPRFPRMLPTLCDPGKQNTDEQFQCTQGAKDSLETSRIQNTSSQGRPRESTAQAKATQFNSALFTLSSHRQGPSASPSCHWDSTRMSVEPVSSEIYNAESRNKDDGKVHLKWKMEVKEMAKKAATGQLTVPPWHPQSSLTLESEAENEPDALLQPPIRSPENTDWQRVIEYHRENDEPRGNGKFDKTGNNDCDSDQHGRQPRLGSFTSIRHPSPRQKEQPEHSEAFQASSDTLVAVEKSYSTSSPIEEDFEGIQGAFAQPQVSGEEKFQMRKILGKNAEILPRSQFQPVRSTEDEQEETSKESPKELKEKDISLTDIQDLSSISYEPDSSFKEASCKTPKINHAPTSVSTPLSPGSVSSAASQYKDCLESITFQVKTEFASCWNSQEFIQTLSDDFISVRERAKKLDSLLTSSETPPSRLTGLKRLSSFIGAGSPSLVKACDSSPPHATQRRSLPKVEAFSQHHIDELPPPSQELLDDIELLKQQQGSSTVLHENTASDGGGTANDQRHLEEQETDSKKEDSSMLLSKETEDLGEDTERAHSTLDEDLERWLQPPEESVELQDLPKGSERETNIKDQKVGEEKRKREDSITPERRKSEGVLGTSEEDELKSCFWKRLGWSESSRIIVLDQSDLSD

SEQ ID NO: 66798 - protein, 1491 aa, Homo sapiens
MSRAVRLPVPCPVQLGTLRNDSLEAQLHEYVKQGNYVKVKKILKKGIYVDAVNSLGQTALFVAALLGLRKFVDVLVDYGSDPNHRCFDGSTPVHAAAFSGNQWILSKLLDAGGDLRLHDERGQNPKTWALTAGKERSTQIVEFMQRCASHMQAIIQGFSYDLLKKIDSPQRLVYSPSWCGGLVQGNPNGSPNRLLKAGVISAQNIYSFGFGKFYLTGATQMAYLGSLPVIGEKEVIQADDEPTFSFFSGPYMVMTNLVWNGSRVTVKELNLPTHPHCSRLRLADLLIAEQEHSSKLRHPYLLQLMAVCLSQDLEKTRLVYERITIGTLFSVLHERRSQFPVLHMEVIVHLLLQISDALRYLHFQGFIHRSLSSYAVHIISPGEARLTNLEYMLESEDRGVQRDLTRVPLPTQLYNWAAPEVILQKAATVKSDIYSFSMIMQEILTDDIPWKGLDGSVVKKAVVSGNYLEADVRLPKPYYDIVKSGIHVKQKDRTMNLQDIRYILKNDLKDFTGAQRTQPTESPRVQRYGLHPDVNVYLGLTSEHPRETPDMEIIELKEMGSQPHSPRVHSLFTEGTLDPQAPDPCLMARETQNQDAPCPAPFMAEEASSPSTGQPSLCSFEINEIYSGCLILEDDIEEPPGAASSLEADGPNQVDELKSMEEELDKMEREACCFGSEDESSSKAETEYSFDDWDWQNGSLSSLSLPESTREAKSNLNNMSTTEEYLISKCVLDLKIMQTIMHENDDRLRNIEQILDEVEMKQKEQEERMSLWATSREFTNAYKLPLAVGPPSLNYIPPVLQLSGGQKPDTSGNYPTLPRFPRMLPTLCDPGKQNTDEQFQCTQGAKDSLETSRIQNTSSQGRPRESTAQAKATQFNSALFTLSSHRQGPSASPSCHWDSTRMSVEPVSSEIYNAESRNKDDGKVHLKWKMEVKEMAKKAATGQLTVPPWHPQSSLTLESEAENEPDALLQPPIRSPENTDWQRVIEYHRENDEPRGNGKFDKTGNNDCDSDQHGRQPRLGSFTSIRHPSPRQKEQPEHSEAFQASSDTLVAVEKSYSHQSMQSTCSPESSEDITDEFLTPDGEYFYSSTAQENLALETSSPIEEDFEGIQGAFAQPQVSGEEKFQMRKILGKNAEILPRSQFQPVRSTEDEQEETSKESPKELKEKDISLTDIQDLSSISYEPDSSFKEASCKTPKINHAPTSVSTPLSPGSVSSAASQYKDCLESITFQVKTEFASCWNSQEFIQTLSDDFISVRERAKKLDSLLTSSETPPSRLTGLKRLSSFIGAGSPSLVKACDSSPPHATQRRSLPKVEAFSQHHIDELPPPSQELLDDIELLKQQQGSSTVLHENTASDGGGTANDQRHLEEQETDSKKEDSSMLLSKETEDLGEDTERAHSTLDEDLERWLQPPEESVELQDLPKGSERETNIKDQKVGEEKRKREDSITPERRKSEGVLGTSEEDELKSCFWKRLGWSESSRIIVLDQSDLSD

SEQ ID NO: 66799 - protein, 2789 aa, Homo sapiens
MPSDAKDSVNGDLLLNWTSLKNILSGLNASFPLHNNTGSSTVTTSKSIKDPRLMRREESMGEQSSTAGLNEVLQFEKSSDNVNSEIKSTPSNSASSSEVVPGDCAVLTNGLDTPCFKTSVNDSQSWAHNMGSEDYDCIPPNKVTMAGQCKDQGNFSFPISVSNVVSEVENQNHSEEKAQRAQQESGNAYTKEYSSHIFQDSQSSDLKTIYQTGCQTSTVFPLKKKVSIDEYLQNTGKMKNFADLEDSSKHEEKQTSWKEIDNDFTNETKISPIDNYIVLHQEYKESESHNSFGKSCDKILITQELEITKSSTSTIKDKDELDHLALEWQITPSFESLSQKHPQHSVEYEGNIHTSLAIAQKLMELKLGKINQNYASIITEAFPKPKDIPQAKEMFIDTVISSYNIETAHDSSNCSITREHICVHRKNENEPVSLENIQRDYKETAYVEDRGQDHNLFCNSQLSNDIWLNVNFKKQTDRENQNEAKENSASCVENNIENIYGDKKQDSHTNENFSNIDEKEDKNYHNIEILSSEEFSTKFNLICREDNAVSAATALLESEEDTISAVKQKDTENTGRSVEHLASTTFPKTASSSVCVASNAAIQIASATMPALSLNNDDHQIYQFKETCSSESPDFGLLVKHRVSDCEIDTDKNKSQESFHQSINENLVLQSIELESEIEIELEDCDDAFIFQQDTHSHENMLCEEFVTSYKALKSRISWEGLLALDNGEMEVLESTTGRENSDQHYSKESNYFYSSTQNNETELTSPILLPDLQIKITNIFRPGFSPTADSLALKDSFCTHVTEATKPEINKEDGEILGFDIYSQPFGENADYPCEDKVDNIRQESGPVSNSEISLSFDLSRNTDVNHTSENQNSESLFTEPSNVTTIDDGSRCFFTKSKTDYNDTKNKKEVESRISKRKLHISSRDQNIPHKDLRRHKIYGRKRRLTSQDSSECFSSLSQGRIKTFSQSEKHIKSVLNILSDEASLCKSKCLSRKLDKAVVHLKKAHRRVHTSLQLITKVGEERKGPLPKSYAIICNNFWESCDLQGYSSVSQRKYYSTKHFSSKRKYDKRRKKRAPKADISKSLTHVSKHKSYKTSGEKKCLSRKSMASSVSKSHPTTSHMGEFCNQEHPESQLPVSSTSQSTSQSVYYNSSVSNPSLSEEHQPFSGKTAYLFSPDHSDEKLIEKENQIDTAFLSSTSKYEKLEKHSANHNVKDATKENSCDANEVINESNSVSLSCIKENINSSTGNDCDATCIGHTKAKTDVLISVLDSNVKHFLNDLYQQGNLILSDCKRNLEVKWTDPIERPKQNIITGNFLMGPLNLTLIASKKYSIPQLSAAAVTDSEGESSKSYLDKQRILTVDSFAASSTVPHCEQSCREKELLKTEQCSSGNCLHTDGNETNVTENYELDVASGTEEDKSYGENIVELSSSDSSLLLKDNVKGSSSETCIVKKDTEDRITWKVKQAEKAKDSVYKRSMTEGSTVNTEYKNQKNQISEESCLNEKIITTNLIDSHLSTKNTTTESVPLKNTVSNPLNKREKKGEIKVSKDSQSDLTLHSEIAYISKPGILGVNHTPILPAHSETCKVPTLLKKPASYVSDFKEKHCSANHTALIANLSQILQRADEASSLQILQEETKVCLNILPLFVEAFERKQECSVEQILISRELLVDQNLWNNCKHTLKPCAVDTLVELQMMMETIQFIENKKRHLEGEPTLRSLLWYDETLYAELLGKPRGFQQQSNFYPGFQGRLKYNAFCELQTYHDQLVELLEETKREKNSYYVFLKYKRQVNECEAIMEHCSDCFDFSLSVPFTCGVNFGDSLEDLEILRKSTLKLINVCGDSPKVHSYPGKQDHLWIIIEMISSKVNFIKNNEAVRVKISLYGLEHIFFDAAKNLVWKERTQSFSKKYSQKKDEERLLRVNKCAFSKLQKIYDTLSKDLNNEPISPIGLEEDTIIASRKSDHPINEATISIENSKFNSNLLAHPDICCISEILDQAEFADLKKLQDLTLRCTDHLEILKKYFQMLQDNNMDNIFITEENVLDVVINHSHEAIILKPEAIEMYIEIVMVSETIHFLKNSIAKKLDKQRFRGMLWFDLSLLPELVQCQEKMASFSFLKDNSTDVCLWKVIETAVSELKKDLDIICKYNEAVNCSYAIHLLSRELQELSEIKKLLKKSKYFISTYIDFVPYIASINYGSTVTELEYNYNQFSTLLKNVMSAPRKDLGKMAHIRKVMKTIEHMKMICTKNAELTISFFLCQMLYNRRKILQLKRKEKMNIHIVKPGENNNKFSISTMLPPVSECINKNISNSSKKRPSTVDKCEDSQEQQQDTTVSSCKKLKVDMKDVTKINREKATFKHPRTTGSHPKSENKIVPSSCDSLKRNHLTPKKVEMQRSLPGSLLPLENPKDTCASKSESKIDLTVSSDHFSGQQENLNSMKKRNVNFSAAETKSDKKDCAAFAICDQKSVHGTFSPDHGTLLQKFLKNSPDPTQKSCLSDINPETDVSLVPDASVLSKPIFCFVKDVHPDLEMNDTVFELQDNDIVNSSIKNSSCMTSPEPICIQNKIPTLQINKLQPTETESEDKYMKDTLNPNTVHTFGASGHITLNVNQGAEYSLSEQQNDKNSKVLMQNAATYWNELPQSACNPTYNSSEHLFGTSYPYSAWCVYQYSNSNGNAITQTYQGITSYEVQPSPSGLLTTVASTAQGTHSNLLYSQYFTYFAGEPQANGFVPVNGYFQSQIPASNFRQPIFSQYASHQPLPQATYPYLPNRFVPPEVPWVYAPWHQESFHPGH

SEQ ID NO: 66800 - protein, 410 aa, Homo sapiens
MVLKAEHTRSPSATLPSNVPSCRSLSSSEDGPSGPSSLADGGLAHNLQDSVRHRILYLSEQLRVEKASRDGNTVSYLKLVSKADRHQVPHIQQAFEKVNQRASATIAQIEHRLHQCHQQLQELEEGCRPEGLLLMAESDPANCEPPSEKALLSEPPEPGGEDGPVNLPHASRPFILESRFQSLQQGTCLETEDVAQQQNLLLQKVKAELEEAKRFHISLQESYHSLKERSLTDLQLLLESLQEEKCRQALMEEQVNGRLQGQLNEIYNLKHNLACSEERMAYLSYERAKEIWEITETFKSRISKLEMLQQVTQLEAAEHLQSRPPQMLFKFLSPRLSLATVLLVFVSTLCACPSSLISSRLCTCTMLMLIGLGVLAWQRWRAIPATDWQEWVPSRCRLYSKDSGPPADGP

SEQ ID NO: 66801 - protein, 410 aa, Homo sapiens; identical to SEQ ID NO: 66800

SEQ ID NO: 66802 - protein, 314 aa, Homo sapiens
MRPEGSLTYRVPERLRQGFCGVGRAAQALVCASAKEGTAFRMEAVQEGAAGVESEQAALGEEAVLLLDDIMAEVEVVAEVEVVAEEEGLVERREEAQRAQQAVPGPGPMTPESAPEELLAVQVELEPVNAQARKAFSRQREKMERRRKPHLDRRGAVIQSVPGFWANVIANHPQMSALITDEDEDMLSYMVSLEVGEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 66803 - protein, 308 aa, Homo sapiens
MRPEGSLTYRVPERLRQGFCGVGRAAQALVCASAKEGTAFRMEAVQEGAAGVESEQAALGEEAVLLLDDIMAEVEVVAEEEGLVERREEAQRAQQAVPGPGPMTPESAPEELLAVQVELEPVNAQARKAFSRQREKMERRRKPHLDRRGAVIQSVPGFWANVIANHPQMSALITDEDEDMLSYMVSLEVGEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 66804 - protein, 698 aa, Homo sapiens
MMRSRSKSPRRPSPTARGANCDVELLKTTTRDREELKCMLEKYERHLAEIQGNVKVLKSERDKIFLLYEQAQEEITRLRREMMKSCKSPKSTTAHAILRRVETERDVAFTDLRRMTTERDSLRERLKIAQETAFNEKAHLEQRIEELECTVHNLDDERMEQMSNMTLMKETISTVEKEMKSLARKAMDTESELGRQKAENNSLRLLYENTEKDLSDTQRHLAKKKYELQLTQEKIMCLDEKIDNFTRQNIAQREEISILGGTLNDLAKEKECLQACLDKKSENIASLGESLAMKEKTISGMKNIIAEMEQASRQCTEALIVCEQDVSRMRRQLDETNDELAQIARERDILAHDNDNLQEQFAKAKQENQALSKKLNDTHNELNDIKQKVQDTNLEVNKLKNILKSEESENRQMMEQLRKANEDAENWENKARQSEADNNTLKLELITAEAEGNRLKEKVDSLNREVEQHLNAERSYKSQISTLHKSVVKMEEELQKVQFEKVSALADLSSTRELCIKLDSSKELLNRQLVAKDQEIEMRENELDSAHSEIELLRSQMANERISMQNLEALLVANRDKEYQSQIALQEKESEIQLLKEHLCLAENKMAIQSRDVAQFRNVVTQLEADLDITKRQLGTERFERERAVQELRRQNYSSNAYHMSSTMKPNTKCHSPERAHHRSPDRGLDRSLEENLCYRDF

SEQ ID NO: 66805 - protein, 690 aa, Homo sapiens
MMRSRSKSPRRPSPTARGANCDVELLKTTTRDREELKCMLEKYERHLAEIQGNVKVLKSERDKIFLLYEQAQEEITRLRREMMKSCKSPKSTTAHAILRRVETERDVAFTDLRRMTTERDSLRERLKIAQETAFNEKAHLEQRIEELECTVHNLDDERMEQMSNMTLMKETISTVEKEMKSLARKAMDTESELGRQKAENNSLRLLYENTEKDLSDTQRHLAKKKYELQLTQEKIMCLDEKIDNFTRQNIAQREEISILGGTLNDLAKEKECLQACLDKKSENIASLGESLAMKEKTISGMKNIIAEMEQASRQCTEALIVCEQDVSRMRRQLDETNDELAQIARERDILAHDNDNLQEQFAKAKQENQALSKKLNDTHNELNDIKQKVQDTNLEVNKLKNILKSEESENRQMMEQLRKANEDAENWENKARQSEADNNTLKLELITAEAEGNRLKEKVDSLNREVEQHLNAERSYKSQISTLHKSVVKMEEELQKVQFEKVSALADLSSTRELCIKLDSSKELLNRQLVAKDQEIEMRENELDSAHSEIELLRSQMANERISMQNLEALLVANRDKEYQSQIALQEKESEIQLLKEHLCLAENKMAIQSRDVAQFRNVVTQLEADLDITKRQLGTERFERERAVQELRRQNYSSNAYHMSSTMKPNTKCHSPERAHHRSPDRGLDRSLE

SEQ ID NO: 66806 - protein, 698 aa, Homo sapiens; identical to SEQ ID NO: 66804

SEQ ID NO: 66807 - protein, 698 aa, Homo sapiens; identical to SEQ ID NO: 66804

SEQ ID NO: 66808 - protein, 698 aa, Homo sapiens; identical to SEQ ID NO: 66804

SEQ ID NO: 66809 - protein, 297 aa, Homo sapiens
MMRSRSKSPRRPSPTARGANCDVELLKTTTRDREELKCMLEKYERHLAEIQGNVKVLKSERDKIFLLYEQAQEEITRLRREMMKSCKSPKSTTAHAILRRVETERDVAFTDLRRMTTERDSLRERLKIAQETAFNEKAHLEQRIEELECTVHNLDDERMEQMSNMTLMKETISTVEKEMKSLARKAMDTESELGRQKAENNSLRLLYENTEKDLSDTQRHLAKKKYELQLTQEKIMCLDEKIDNFTRQNIAQREEISILGGTLNDLAKEKECLQACLDKKSENIASLGESLAMKTVY

SEQ ID NO: 66810 - protein, 626 aa, Homo sapiens
MAGERPPLRGPGPGPGEVPGEGPPGPGGTGGGPGRGRPSSYRALRSAVSSLARVDDFHCAEKIGAGFFSEVYKVRHRQSGQVMVLKMNKLPSNRGNTLREVQLMNRLRHPNILRFMGVCVHQGQLHALTEYMNGGTLEQLLSSPEPLSWPVRLHLALDIARGLRYLHSKGVFHRDLTSKNCLVRREDRGFTAVVGDFGLAEKIPVYREGARKEPLAVVGSPYWMAPEVLRGELYDEKADVFAFGIVLCELIARVPADPDYLPRTEDFGLDVPAFRTLVGDDCPLPFLLLAIHCCNLEPSTRAPFTEITQHLEWILEQLPEPAPLTRTALTHNQGSVARGGPSATLPRPDPRLSRSRSDLFLPPSPESPPNWGDNLTRVNPFSLREDLRGGKIKLLDTPSKPVLPLVPPSPFPSTQLPLVTTPETLVQPGTPARRCRSLPSSPELPRRMETALPGPGPPAVGPSAEEKMECEGSSPEPEPPGPAPQLPLAVATDNFISTCSSASQPWSPRSGPVLNNNPPAVVVNSPQGWAGEPWNRAQHSLPRAAALERTEPSPPPSAPREPDEGLPCPGCCLGPFSFGFLSMCPRPTPAVARYRNLNCEAGSLLCHRGHHAKPPTPSLQLPGARS

SEQ ID NO: 66811 - protein, 157 aa, Homo sapiens
SARAAALSRNLQGQRPLPLAVATDNFISTCSSASQPWSPRSGPVLNNNPPAVVVNSPQGWAGEPWNRAQHSLPRAAALERTEPSPPPSAPREPDEGLPCPGCCLGPFSFGFLSMCPRPTPAVARYRNLNCEAGSLLCHRGHHAKPPTPSLQLPGARS

SEQ ID NO: 66812 - protein, 358 aa, Homo sapiens
MDDATVLRKKGYIVGINLGKGSYAKVKSAYSERLKFNVAVKIIDRKKTPTDFVERFLPREMDILATVNHGSIIKTYEIFETSDGRIYIIMELGVQGDLLEFIKCQGALHEDVARKMFRQLSSAVKYCHDLDIVHRDLKCENLLLDKDFNIKLSDFGFSKRCLRDSNGRIILSKTFCGSAAYAAPEVLQSIPYQPKVYDIWSLGVILYIMVCGSMPYDDSDIRKMLRIQKEHRVDFPRSKNLTCECKDLIYRMLQPDVSQRLHIDEILSHSWLQPPKPKATSSASFKREGEGKYRAECKLDTKTGLRPDHRPDHKLGAKTQHRLLVVPENENRMEDRLAETSRAKDHHISGAEVGKAST

SEQ ID NO: 66813 - protein, 268 aa, Homo sapiens
MEDFLLSNGYQLGKTIGEGTYSKVKEAFSKKHQRKVAIKVIDKMGGPEEFIQRFLPRELQIVRTLDHKNIIQVYEMLESADGKICLVMELAEGGDVFDCVLNGGPLPESRAKALFRQMVEAIRYCHGCGVAHRDLKCENALLQGFNLKLTDFGFAKVLPKSHRELSQTFCGSTAYAAPEVLQGIPHDSKKGDVWSMGVVLYVMLCASLPFDDTDIPKMLWQQQKGVSFPTHLSISADCQDLLKRLLEPDMILRPSIEEVSWHPWLAST

SEQ ID NO: 66814 - protein, 328 aa, Homo sapiens
MGKGDVLEAAPTTTAYHSLMDEYGYEVGKAIGHGSYGSVYEAFYTKQKVMVAVKIISKKKASDDYLNKFLPREIQVMKVLRHKYLINFYRAIESTSRVYIILELAQGGDVLEWIQRYGACSEPLAGKWFSQLTLGIAYLHSKSIVHRDLKLENLLLDKWENVKISDFGFAKMVPSNQPVGCSPSYRQVNCFSHLSQTYCGSFAYACPEILRGLPYNPFLSDTWSMGVILYTLVVAHLPFDDTNLKKLLRETQKEVTFPANHTISQECKNLILQMLRQATKRATILDIIKDSWVLKFQPEQPTHEIRLLEAMCQLHNTTKQHQSLQITT

SEQ ID NO: 66815 - protein, 338 aa, Homo sapiens
MGKGDVLEAAPTTTAYHSLMDEYGYEVGKAIGHGSYGSVYEAFYTKQKVMVAVKIISKKKASDDYLNKFLPREIQVMKVLRHKYLINFYRAIESTSRVYIILELAQGGDVLEWIQRYGACSEPLAGKWFSQLTLGIAYLHSKSIVHRLMPSLSAAGRDLKLENLLLDKWENVKISDFGFAKMVPSNQPVGCSPSYRQVNCFSHLSQTYCGSFAYACPEILRGLPYNPFLSDTWSMGVILYTLVVAHLPFDDTNLKKLLRETQKEVTFPANHTISQECKNLILQMLRQATKRATILDIIKDSWVLKFQPEQPTHEIRLLEAMCQLHNTTKQHQSLQITT

SEQ ID NO: 66816 - protein, 252 aa, Homo sapiens
MKVLRHKYLINFYRAIESTSRVYIILELAQGGDVLEWIQRYGACSEPLAGKWFSQLTLGIAYLHSKSIVHRDLKLENLLLDKWENVKISDFGFAKMVPSNQPVGCSPSYRQVNCFSHLSQTYCGSFAYACPEILRGLPYNPFLSDTWSMGVILYTLVVAHLPFDDTNLKKLLRETQKEVTFPANHTISQECKNLILQMLRQATKRATILDIIKDSWVLKFQPEQPTHEIRLLEAMCQLHNTTKQHQSLQITT

SEQ ID NO: 66817 - protein, 273 aa, Homo sapiens
MSGDKLLSELGYKLGRTIGEGSYSKVKVATSKKYKGTVAIKVVDRRRAPPDFVNKFLPRELSILRGVRHPHIVHVFEFIEVCNGKLYIVMEAAATDLLQAVQRNGRIPGVQARDLFAQIAGAVRYLHDHHLVHRDLKCENVLLSPDERRVKLTDFGFGRQAHGYPDLSTTYCGSAAYASPEVLLGIPYDPKKYDVWSMGVVLYVMVTGCMPFDDSDIAGLPRRQKRGVLYPEGLELSERCKALIAELLQFSPSARPSAGQVARNCWLRAGDSG

SEQ ID NO: 66818 - protein, 273 aa, Homo sapiens; identical to SEQ ID NO: 66817

SEQ ID NO: 66819 - protein, 2136 aa, Homo sapiens
MSRSRHARPSRLVRKEDVNKKKKNSQLRKTTKGANKNVASVKTLSPGKLKQLIQERDVKKKTEPKPPVPVRSLLTRAGAARMNLDRTEVLFQNPESLTCNGFTMALRSTSLSRRLSQPPLVVAKSKKVPLSKGLEKQHDCDYKILPALGVKHSENDSVPMQDTQVLPDIETLIGVQNPSLLKGKSQETTQFWSQRVEDSKINIPTHSGPAAEILPGPLEGTRCGEGLFSEETLNDTSGSPKMFAQDTVCAPFPQRATPKVTSQGNPSIQLEELGSRVESLKLSDSYLDPIKSEHDCYPTSSLNKVIPDLNLRNCLALGGSTSPTSVIKFLLAGSKQATLGAKPDHQEAFEATANQQEVSDTTSFLGQAFGAIPHQWELPGADPVHGEALGETPDLPEIPGAIPVQGEVFGTILDQQETLGMSGSVVPDLPVFLPVPPNPIATFNAPSKWPEPQSTVSYGLAVQGAIQILPLGSGHTPQSSSNSEKNSLPPVMAISNVENEKQVHISFLPANTQGFPLAPERGLFHASLGIAQLSQAGPSKSDRGSSQVSVTSTVHVVNTTVVTMPVPMVSTSSSSYTTLLPTLEKKKRKRCGVCEPCQQKTNCGECTYCKNRKNSHQICKKRKCEELKKKPSVVVPLEVIKENKRPQREKKPKVLKADFDNKPVNGPKSESMDYSRCGHGEEQKLELNPHTVENVTKNEDSMTGIEVEKWTQNKKSQLTDHVKGDFSANVPEAEKSKNSEVDKKRTKSPKLFVQTVRNGIKHVHCLPAETNVSFKKFNIEEFGKTLENNSYKFLKDTANHKNAMSSVATDMSCDHLKGRSNVLVFQQPGFNCSSIPHSSHSIINHHASIHNEGDQPKTPENIPSKEPKDGSPVQPSLLSLMKDRRLTLEQVVAIEALTQLSEAPSENSSPSKSEKDEESEQRTASLLNSCKAILYTVRKDLQDPNLQGEPPKLNHCPSLEKQSSCNTVVFNGQTTTLSNSHINSATNQASTKSHEYSKVTNSLSLFIPKSNSSKIDTNKSIAQGIITLDNCSNDLHQLPPRNNEVEYCNQLLDSSKKLDSDDLSCQDATHTQIEEDVATQLTQLASIIKINYIKPEDKKVESTPTSLVTCNVQQKYNQEKGTIQQKPPSSVHNNHGSSLTKQKNPTQKKTKSTPSRDRRKKKPTVVSYQENDRQKWEKLSYMYGTICDIWIASKFQNFGQFCPHDFPTVFGKISSSTKIWKPLAQTRSIMQPKTVFPPLTQIKLQRYPESAEEKVKVEPLDSLSLFHLKTESNGKAFTDKAYNSQVQLTVNANQKAHPLTQPSSPPNQCANVMAGDDQIRFQQVVKEQLMHQRLPTLPGISHETPLPESALTLRNVNVVCSGGITVVSTKSEEEVCSSSFGTSEFSTVDSAQKNFNDYAMNFFTNPTKNLVSITKDSELPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 66820 - protein, 109 aa, Homo sapiens
MADRLYTELTENLKSYNGHPTDRRCTLNENRTCTCQGIDPETCGASFSFGCSWSMYFNGCKFGRSPSPRRFRIDPSSPLHTYYERITKGRNPERRYMKPERISPGHEAM

SEQ ID NO: 66821 - protein, 241 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLELAAMIVSMYLYCNLQ

SEQ ID NO: 66822 - protein, 305 aa, Homo sapiens
MAREDSVKCLRCLLYALNLLFWLMSISVLAVSAWMRDYLNNVLTLTAETRVEEAVILTYFPVVHPVMIAVCCFLIIVGMLGYCGTVKRNLLLLAWYFGSLLVIFCVELACGVWTYEQELMVPVQWSDMVTLKARMTNYGLPRYRWLTHAWNFFQREFKCCGVVYFTDWLEMTEMDWPPDSCCVREFPGCSKQAHQEDLSDLYQEGCGKKMYSFLRGTKQLQVLRFLGISIGVTQILAMILTITLLWALYYDRREPGTDQMMSLKNDNSQHLSCPSVELLKPSLSRIFEHTSMANSFNTHFEMEEL

SEQ ID NO: 66823 - protein, 305 aa, Homo sapiens; identical to SEQ ID NO: 66822

SEQ ID NO: 66824 - protein, 112 aa, Homo sapiens
MAREDSVKCLRCLLYALNLLFWLMSISVLAVSAWMRDYLNNVLTLTAETRVEEAVILTYFPVVHPVMIAVCCFLIIVGMLGYCGTVKRNLLLLAWYFGSLLVIFCVELACGV

SEQ ID NO: 66825 - protein, 95 aa, Homo sapiens
MAREDSVKCLRCLLYALNLLFWLMSISVLAVSAWMRDYLNNVLTLTAETRVEEAVILTYFPVVHPVMIAVCCFLIIVGMLGYCGTVKRNLLLLAW

SEQ ID NO: 66826 - protein, 120 aa, Homo sapiens
MAREDSVKCLRCLLYALNLLFWLMSISVLAVSAWMRDYLNNVLTLTAETRVEEAVILTYFPVVHPVMIAVCCFLIIVGMLGYCGTVKRNLLLLAWYFGSLLVIFCVELACGVWTYEQELM

SEQ ID NO: 66827 - protein, 147 aa, Homo sapiens
MAREDSVKCLRCLLYALNLLFWLMSISVLAVSAWMRDYLNNVLTLTAETRVEEAVILTYFPVVHPVMIAVCCFLIIVGMLGYCGTVKRNLLLLAWYFGSLLVIFCVELACGVWTYEQELMVPVQWSDMVTLKARMTNYGLPRYRWLT

SEQ ID NO: 66828 - protein, 294 aa, Homo sapiens
MPRGDSEQVRYCARFSYLWLKFSLIIYSTVFWLIGALVLSVGIYAEVERQKYKTLESAFLAPAIILILLGVVMFMVSFIGVLASLRDNLYLLQAFMYILGICLIMELIGGVVALTFRNQTIDFLNDNIRRGIENYYDDLDFKNIMDFVQKKFKCCGGEDYRDWSKNQYHDCSAPGPLACGVPYTCCIRNTTEVVNTMCGYKTIDKERFSVQDVIYVRGCTNAVIIWFMDNYTIMAGILLGILLPQFLGVLLTLLYITRVEDIIMEHSVTDGLLGPGAKPSVEAAGTGCCLCYPN

SEQ ID NO: 66829 - protein, 193 aa, Homo sapiens
MGRFRGGLRCIKYLLLGFNLLFWLAGSAVIAFGLWFRFGGAIKELSSEDKSPEYFYVGLYVLVGAGALMMAVGFFGCCGAMRESQCVLGSFFTCLLVIFAAEVTTGVFAFIGKGVAIRHVQTMYEEAYNDYLKDRGKGNGTLITFHSTFQCCGKESSEQVQPTCPKELLGHKIFGMIFSMVLCCAIRNSRDVI

SEQ ID NO: 66830 - protein, 196 aa, Homo sapiens
MGRFRGGLRCIKYLLLGFNLLFWLAGSAVIAFGLWFRFGGAIKELSSEDKSPEYFYVGLYVLVGAGALMMAVGFFGCCGAMRESQCVLGSAIRHVQTMYEEAYNDYLKDRGKGNGTLITFHSTFQCCGKESSEQVQPTCPKELLGHKNCIDEIETIISVKLQLIGIVGIGIAGLTIFGMIFSMVLCCAIRNSRDVI

SEQ ID NO: 66831 - protein, 221 aa, Homo sapiens
MGRFRGGLRCIKYLLLGFNLLFWLAGSAVIAFGLWFRFGGAIKELSSEDKSPEYFYVGLYVLVGAGALMMAVGFFGCCGAMRESQCVLGSFFTCLLVIFAAEVTTGVFAFIGKGVAIRHVQTMYEEAYNDYLKDRGKGNGTLITFHSTFQCCGKESSEQVQPTCPKELLGHKNCIDEIETIISVKLQLIGIVGIGIAGLTIFGMIFSMVLCCAIRNSRDVI

SEQ ID NO: 66832 - protein, 187 aa, Homo sapiens
GLRCIKYLLLGFNLLFWLAGSAVIAFGLWFRFGGAIKELSSEDKSPEYFYVGLYVLVGAGALMMAVGFFGCCGAMRESQCVLGSFFTCLLVIFAAEVTTGVFAFIGKGVAIRHVQTMYEEAYNDYLKDRGKGNGTLITFHSTFQCCGKESSEQVQPTCPKELLGHKIFGMIFSMVLCCAIRNSRDVI

SEQ ID NO: 66833 - protein, 253 aa, Homo sapiens
MGQCGITSSKTVLVFLNLIFWGAAGILCYVGAYVFITYDDYDHFFEDVYTLIPAVVIIAVGALLFIIGLIGCCATIRESRCGLATFVIILLLVFVTEVVVVVLGYVYRAKVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQLLGMLCACIVLCRRSRDPAYELLITGGTYA

SEQ ID NO: 66834 - protein, 228 aa, Homo sapiens
MGQCGITSSKTVLVFLNLIFWGAAGILCYVGAYVFITYDDYDHFFEDVYTLIPAVVIIAVGALLFIIGLIGCCATIRESRCGLATVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQLLGMLCACIVLCRRSRDPAYELLITGGTYA

SEQ ID NO: 66835 - protein, 216 aa, Homo sapiens
MWEPMSSSLMMTMTTSLKMCTRSSLLFIIGLIGCCATIRESRCGLATFVIILLLVFVTEVVVVVLGYVYRAKVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQQLLGMLCACIVLCRRSRDPAYELLITGGTYA

SEQ ID NO: 66836 - protein, 189 aa, Homo sapiens
MGQCGITSSKTVLVFLNLIFWFVIILLLVFVTEVVVVVLGYVYRAKVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQLLGMLCACIVLCRRSRDPAYELLITGGTYA

SEQ ID NO: 66837 - protein, 210 aa, Homo sapiens
MVCGGFACSKNALCALNVVYMLVSLLLIGVAAWGKGLGLVSSIHIIGGVIAVGVFLLLIAVAGLVGAVNHHQVLLFFYMIILGLVFIFQFVISCSCLAINRSKQTDVINASWWVMSNKTRDELERSFDCCGLFNLTTLYQQDYDFCTAICKSQSPTCQMCGEKFLKHSDEALKILGGVGLFFSFTEILGVWLAMRFRNQKDPRANPSAFL

SEQ ID NO: 66838 - protein, 320 aa, Homo sapiens
MGPWSRVRVAKCQMLVTCFFILLLGLSVATMVTLTYFGAHFAVIRRASLEKNPYQAVHQWAFSAGLSLVGLLTLGAVLSAAATVREAQGLMAGGFLCFSLAFCAQVQVVFWRLHSPTQVEDAMLDTYDLVYEQAMKGTSHVRRQELAAIQDVFLCCGKKSPFSRLGSTEADLCQGEEAAREDCLQGIRSFLRTHQQVASSLTSIGLALTVSALLFSSFLWFAIRCGCSLDRKGKYTLTPRACGRQPQEPSLLRCSQGGPTHCLHSEAVAIGPRGCSGSLRWLQESDAAPLPLSCHLAAHRALQGRSRGGLSGCPERGLSD

SEQ ID NO: 66839 - protein, 253 aa, Homo sapiens
MGPWSRVRVAKCQMLVTCFFILLLGLSVATMVTLTYFGAHFAVIRRASLEKNPYQAVHQWAFSAGLSLVGLLTLGAVLSAAATVREAQGLMAGGFLCFSLAFCAQVQVVFWRLHSPTQVEDAMLDTYDLVYEQAMKGTSHVRRQELAAIQDVFLCCGKKSPFSRLGSTEADLCQGEEAAREDCLQGIRSFLRTHQQVASSLTSIGLALTVSALLFSSFLWFAIRCGCSLDRKGKYTLTPRSPGQKSRWAQWVP

SEQ ID NO: 66840 - protein, 174 aa, Homo sapiens
MAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 66841 - protein, 238 aa, Homo sapiens
MARACLQAVKYLMFAFNLLFWLGGCGVLGVGIWLAATQGSFATLSSSFPSLSAANLLIITGAFVMAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 66842 - protein, 238 aa, Homo sapiens; identical to SEQ ID NO: 66841

SEQ ID NO: 66843 - protein, 238 aa, Homo sapiens; identical to SEQ ID NO: 66841

SEQ ID NO: 66844 - protein, 238 aa, Homo sapiens; identical to SEQ ID NO: 66841

SEQ ID NO: 66845 - protein, 238 aa, Homo sapiens; identical to SEQ ID NO: 66841

SEQ ID NO: 66846 - protein, 257 aa, Homo sapiens
MTPRSAGTSAHGAELKRCGMARACLQAVKYLMFAFNLLFWLGGCGVLGVGIWLAATQGSFATLSSSFPSLSAANLLIITGAFVMAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 66847 - protein, 238 aa, Homo sapiens; identical to SEQ ID NO: 66841

SEQ ID NO: 66848 - protein, 174 aa, Homo sapiens; identical to SEQ ID NO: 66840

SEQ ID NO: 66849 - protein, 100 aa, Homo sapiens
MAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATR

SEQ ID NO: 66850 - protein, 159 aa, Homo sapiens
MARACLQAVKYLMFAFNLLFWLGGCGVLGVGIWLAATQGSFATLSSSFPSLSAANLLIITGAFVMAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEV

SEQ ID NO: 66851 - protein, 85 aa, Homo sapiens
MARACLQAVKYLMFAFNLLFWLGGCGVLGVGIWLAATQGSFATLSSSFPSLSAANLLIITGAFVMAIGFVGCLGAIKENKCLLLT

SEQ ID NO: 66852 - protein, 268 aa, Homo sapiens
MSGKHYKGPEVSCCIKYFIFGFNVIFWFLGITFLGIGLWAWNEKGVLSNISSITDLGGFDPVWLFLVVGGVMFILGFAGCIGALRENTFLLKFFSVFLGIIFFLELTAGVLAFVFKDWIKDQLYFFINNNIRAYRDDIDLQNLIDFTQEYWQCCGAFGADDWNLNIYFNCTDSNASRERCGVPFSCCTKDPAEDVINTQCGYDARQKPEVDQQIVIYTKGCVPQFEKWLQDNLTIVAGIFIGIALLQIFGICLAQNLVSDIEAVRASW

SEQ ID NO: 66853 - protein, 197 aa, Homo sapiens
MFILGFAGCIGALRENTFLLKFFSVFLGIIFFLELTAGVLAFVFKDWIKDQLYFFINNNIRAYRDDIDLQNLIDFTQEYWQCCGAFGADDWNLNIYFNCTDSNASRERCGVPFSCCTKDPAEDVINTQCGYDARQKPEVDQQIVIYTKGCVPQFEKWLQDNLTIVAGIFIGIALLQIFGICLAQNLVSDIEAVRASW

SEQ ID NO: 66854 - protein, 266 aa, Homo sapiens
MASRRMETKPVITCLKTLLIIYSFVFWKEKAAGFCGRQDVAMALITGVILLAVGVWGKLTLGTYISLIAENSTNAPYVLIGTGTTIVVFGLFGCFATCRGSPWMLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 66855 - protein, 249 aa, Homo sapiens
MASRRMETKPVITCLKTLLIIYSFVFWITGVILLAVGVWGKLTLGTYISLIAENSTNAPYVLIGTGTTIVVFGLFGCFATCRGSPWMLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 66856 - protein, 275 aa, Homo sapiens
MANRTVCNGQGRSRDLLRIKNIPNAPGHFLIAGVGGSSSQGRSIEEEGKTHLGITGVILLAVGVWGKLTLGTYISLIAENSTNAPYVLIGTGTTIVVFGLFGCFATCRGSPWMLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 66857 - protein, 223 aa, Homo sapiens
MITGVILLAVGVWGKLTLGTYISLIAENSTNAPYVLIGTGTTIVVFGLFGCFATCRGSPWMLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 66858 - protein, 237 aa, Homo sapiens
MAGVSACIKYSMFTFNFLFWLCGILILALAIWVRVSNDSQAIFGSEDVGSSSYVAVDILIAVGAIIMILGFLGCCGAIKESRCMLLLFFIGLLLILLLQVATGILGAVFKSKSDRIVNETLYENTKLLSATGESEKQFQEAIIVFQEEFKCCGLVNGAADWGNNFQHYPELCACLDKQRPCQSYNGKQVYKETCISFIKDFLAKNLIIVIGISFGLAVIEILGLVFSMVLYCQIGNK

SEQ ID NO: 66859 - protein, 237 aa, Homo sapiens; identical to SEQ ID NO: 66858

SEQ ID NO: 66860 - protein, 237 aa, Homo sapiens; identical to SEQ ID NO: 66858

SEQ ID NO: 66861 - protein, 239 aa, Homo sapiens
MARGCLCCLKYMMFLFNLIFWLCGCGLLGVGIWLSVSQGNFATFSPSFPSLSAANLVIAIGTIVMVTGFLGCLGAIKENKCLLLSFFIVLLVILLAELILLILFFVYMDKVNENAKKDLKEGLLLYHTENNVGLKNAWNIIQAEMRCCGVTDYTDWYPVLGENTVPDRCCMENSQGCGRNATTPLWRTGCYEKVKMWFDDNKHVLGTVGMCILIMQILGMAFSMTLFQHIHRTGKKYDA

SEQ ID NO: 66862 - protein, 239 aa, Homo sapiens; identical to SEQ ID NO: 66861

SEQ ID NO: 66863 - protein, 292 aa, Homo sapiens
MGEKSENCGVPEDLLNGLKVTDTQEAECAGPPVPDPKNQHSQSKLLRDDEAHLQEDQGEEECFHDCSASFEEEPGADKVENKSNEDVNSSELDEEYLIELEKNMSDEEKQKRREESTRLKEEGNEQFKKGDYIEAESSYSRALEMCPSCFQKERSILFSNRAAARMKQDKKEMAINDCSKAIQLNPSYIRAILRRAELYEKTDKLDEALEDYKSILEKDPSIHQAREACMRLPKQIEERNERLKEEMLGKLKDLGNLVLRPFGLSTENFQIKQDSSTGSYSINFVQNPNNNR

SEQ ID NO: 66864 - protein, 292 aa, Homo sapiens; identical to SEQ ID NO: 66863

SEQ ID NO: 66865 - protein, 732 aa, Homo sapiens
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWALKCDEKCTKAYFHMGKANLALKNYSVSRECYKKILEINPKLQTQVKGYLNQVDLQEKADLQEKEAHELLDSGKNTAVTTKNLLETLSKPDQIPLFYAGGIEILTEMINECTEQTLFRMHNGFSIISDNEVIRRCFSTAGNDAVEEMVCVSVLKLWQAVCSRNEENQRVLVIHHDRARLLAALLSSKVLAIRQQSFALLLHLAQTESGRSLIINHLDLTRLLEALVSFLDFSDKEANTAMGLFTDLALEERFQVWFQANLPGVLPALTGVLKTDPKVSSSSALCQCIAIMGNLSAEPTTRRHMAACEEFGDGCLSLLARCEEDVDLFREVIYTLLGLMMNLCLQAPFVSEVWAVEVSRRCLSLLNSQDGGILTRAAGVLSRTLSSSLKIVEEALRAGVVKKMMKFLKTGGETASRYAIKILAICTNSYHEAREEVIRLDKKLSVMMKLLSSEDEVLVGNAALCLGNCMEVPNVASSLLKTDLLQVLLKLAGSDTQKTAVQVNAGIALGKLCTAEPRVPAESSHLQFGRESAAPEALSPRRWEEMFHMLVFSLSSVDPPPPPPQTCYP

SEQ ID NO: 66866 - protein, 107 aa, Homo sapiens
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLAD

SEQ ID NO: 66867 - protein, 202 aa, Homo sapiens
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWALKCDEKCTKAYFHMGKANLALKNYSVSRECYKKILE

SEQ ID NO: 66868 - protein, 167 aa, Homo sapiens
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWAL

SEQ ID NO: 66869 - protein, 705 aa, Homo sapiens
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWALKCDEKCTKAYFHMGKANLALKNYSVSRECYKKILEINPKLQTQVKGYLNQVDLQEKADLQEKEAHELLDSGKNTAVTTKNLLETLSKPDQIPLFYAGGIEILTEMINECTEQTLFRMHNGFSIISDNEVIRRCFSTAGNDAVEEMVCVSVLKLWQAVCSRNEENQRVLVIHHDRARLLAALLSSKVLAIRQQSFALLLHLAQTESGRSLIINHLDLTRLLEALVSFLDFSDKEANTAMGLFTDLALEERFQVWFQANLPGVLPALTGVLKTDPKVSSSSALCQCIAIMGNLSAEPTTRRHMAACEEFGDGCLSLLARCEEDVDLFREVIYTLLGLMMNLCLQAPFVSEVWAVEVSRRCLSLLNSQDGGILTRAAGVLSRTLSSSLKIVEEALRAGVVKKMMKFLKTGGETASRYAIKILAICTNSYHEAREEVIRLDKKLSVMMKLLSSEDEVLVGNAALCLGNCMEVPNVASSLLKTDLLQVLLKLAGSDTQKTAVQVNAGIALGKLCTAEPRFAAQLRKLHGLEILNSTMKYISDS

SEQ ID NO: 66870 - protein, 380 aa, Homo sapiens
MFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKLSIMKDEPEEAELILHDALRLAYQTDNKKAITYTYDLMANLAFIRGQLENAEQLFKATMSYLLGGGMKQEDNAIIEISLKLASIYAAQNRQEFAVAGYEFCISTLEEKIEREKELAEDIMSVEEKANTHLLLGMCLDACARYLLFSKQPSQAQRMYEKALQISEEIQGERHPQTIVLMSDLATTLDAQGRFDEAYIYMQRASDLARQINHPELHMVLSNLAAVLMHRERYTQAKEIYQEALKQAKLKKDEISVQHIREELAELSKKSRPLTNSVKL

SEQ ID NO: 66871 - protein, 380 aa, Homo sapiens; identical to SEQ ID NO: 66870

SEQ ID NO: 66872 - protein, 501 aa, Homo sapiens
MAQPHTTSVPYFARSPAPPPPSRSGAPPQPPATLRPSRRRTRPPRPADRRDAPADCAYLWRILTPRRGRARRSDVGARHRACGRRDVLLSRQGPANPEGARRVVGGQERVWPAVRRGRGGSMFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKLSIMKDEPEEAELILHDALRLAYQTDNKKAITYTYDLMANLAFIRGQLENAEQLFKATMSYLLGGGMKQEDNAIIEISLKLASIYAAQNRQEFAVAGYEFCISTLEEKIEREKELAEDIMSVEEKANTHLLLGMCLDACARYLLFSKQPSQAQRMYEKALQISEEIQGERHPQTIVLMSDLATTLDAQGRFDEAYIYMQRASDLARQINHPELHMVLSNLAAVLMHRERYTQAKEIYQEALKQAKLKKDEISVQHIREELAELSKKSRPLTNSVKL

SEQ ID NO: 66873 - protein, 166 aa, Homo sapiens
  MOD_RES (1)..(1): Any amino acid
XQERVWPAVRRGRGGSMFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKVRRLRALRPAERGSLCERGLGVAAHYSLRLAEEWMEAPRVKLPRMS

SEQ ID NO: 66874 - protein, 1316 aa, Homo sapiens
MDSQELKTLINYYCQERYFHHVLLVASEGIKRYGSDPVFRFYHAYGTLMEGKTQEALREFEAIKNKQDVSLCSLLALIYAHKMSPNPDREAILESDARVKEQRKGAGEKALYHAGLFLWHIGRHDKAREYIDRMIKISDGSKQGHVLKAWLDITRGKEPYTKKALKYFEEGLQDGNDTFALLGKAQCLEMRQNYSGALETVNQIIVNFPSFLPAFVKKMKLQLALQDWDQTVETAQRLLLQDSQNVEALRMQALYYVCREGDIEKASTKLENLGNTLDAMEPQNAQLFYNITLAFSRTCGRSQLILQKIQTLLERAFSLNPQQSEFATELGYQMILQGRVKEALKWYKTAMTLDETSVSALVGFIQCQLIEGQLQDADQQLEFLNEIQQSIGKSAELIYLHAVLAMKKNKRQEEVINLLNDVLDTHFSQLEGLPLGIQYFEKLNPDFLLEIVMEYLSFCPMQPASPGQPLCPLLRRCISVLETVVRTVPGLLQTVFLIAKVKYLSGDIEAAFNNLQHCLEHNPSYADAHLLLAQVYLSQEKVKLCSQSLELCLSYDFKVRDYPLYHLIKAQSQKKMGEIADAIKTLHMAMSLPGMKRIGASTKSKDRKTEVDTSHRLSIFLELIDVHRLNGEQHEATKVLQDAIHEFSGTSEEVRVTIANADLALAQGDIERALSILQNVTAEQPYFIEAREKMADIYLKHRKDKMLYITCFREIAERMANPRSFLLLGDAYMNILEPEEAIVAYEQALNQNPKDGTLASKMGKALIKTHNYSMAITYYEAALKTGQKNYLCYDLAELLLKLKWYDKAEKVLQHALAHEPVNELSALMEDGRCQVLLAKVYSKMEKLGDAITALQQARELQARVLKRVQMEQPDAVPAQKHLAAEICAEIAKHSVAQRDYEKAIKFYREALVHCETDNKIMLELARLYLAQDDPDSCLRQCALLLQSDQDNEAATMMMADLMFRKQDYEQAVFHLQQLLERKPDNYMTLSRLIDLLRRCGKLEDVPRFFSMAEKRNSRAKLEPGFQYCKGLYLWYTGEPNDALRHFNKARKDRDWGQNALYNMIEICLNPDNETVGGEVFENLDGDLGNSTEKQESVQLAVRTAEKLLKELKPQTVQGHVQLRIMENYCLMATKQKSNVEQALNTFTEIAASEKEHIPALLGMATAYMILKQTPRARNQLKRIAKMNWNAIDAEEFEKSWLLLADIYIQSAKYDMAEDLLKRCLRHNRSCCKAYEYMGYIMEKEQAYTDAALNYEMAWKYSNRTNPAVGYKLAFNYLKAKRYVDSIDICHQVLEAHPTYPKIRKDILDKARASLRP

SEQ ID NO: 66875 - protein, 254 aa, Homo sapiens
MIEICLNPDNETVGGEVFENLDGDLGNSTEKQESVQLAVRTAEKLLKELKPQTVQGHVQLRIMENYCLMATKQKSNVEQALNTFTEIAASEKEHIPALLGMATAYMILKQTPRARNQLKRIAKMNWNAIDAEEFEKSWLLLADIYIQSAKYDMAEDLLKRCLRHNRSCCKAYEYMGYIMEKEQAYTDAALNYEMAWKYSNRTNPAVGYKLAFNYLKAKRYVDSIDICHQVLEAHPTYPKIRKDILDKARASLRP

SEQ ID NO: 66876 - protein, 2025 aa, Homo sapiens
MDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGDDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 66877 - protein, 2025 aa, Homo sapiens; identical to SEQ ID NO: 66876

SEQ ID NO: 66878 - protein, 2025 aa, Homo sapiens; identical to SEQ ID NO: 66876

SEQ ID NO: 66879 - protein, 1179 aa, Homo sapiens
MDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLK

SEQ ID NO: 66880 - protein, 780 aa, Homo sapiens
MDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEA

SEQ ID NO: 66881 - protein, 612 aa, Homo sapiens
MLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGMSLYIPEQ

SEQ ID NO: 66882 - protein, 613 aa, Homo sapiens
MDAVLACRLRGRGNRVAALRPRPRPGGSAGPSPFALLCAGLSPEPRAGVGSEFPAWFLGGSSQRRNMALLGSRAELEADEDVFEDALETISMAKESMYHALGYSTIVVLQAVLTFEQQDIQNGISAMKDALQTCQKYRKKYTVVESFSSLLSRGSLEQLSEEEMHAEICYAECLLQKAALTFVQDENMINFIKGGLKIRTSYQIYKECLSILHEIQKNKLQQEFFYEFEGGVKLGSGAFNLMLSLLPARIIRLLEFIGFSGNRELGLLQLREGASGRSMRSALCCLTILAFHTYISLILGTGEVNVAEAERLLAPFLQQFPNGSLVLFYHARIELLKGNLEEAQEVFQKCISVQEEWKQFHHLCYWELMWINVFQQNWMQAYYYSDLLCKESKWSKATYVFLKAAILSMLPEEDVVATNENVVTLFRQVDSLKQRIAGKSIPTEKFAVRKARRYSASLPAPVKLILPALEMMYVWNGFSIVSKRKDLSENLLVTVEKAEAALQSQNFNSFSVDDECLVKLLKGCCLKNLQRPLQAELCYNHVVESEKLLKYDHYLVPFTLFELASLYKSQGEIDKAIKFLETARNNYKDYSLESRLHFRIQAALHLWRKPSSD

SEQ ID NO: 66883 - protein, 616 aa, Homo sapiens
MALLGSRAELEADEDVFEDALETISISSHSDMATSSLHFASCDTQQAPRQRGASTVSSSSSTKVDLKSGLEECAVALNLFLSNKFTDALELLRPWAKESMYHALGYSTIVVLQAVLTFEQQDIQNGISAMKDALQTCQKYRKKYTVVESFSSLLSRGSLEQLSEEEMHAEICYAECLLQKAALTFVQDENMINFIKGGLKIRTSYQIYKECLSILHEIQKNKLQQEFFYEFEGGVKLGSGAFNLMLSLLPARIIRLLEFIGFSGNRELGLLQLREGASGRSMRSALCCLTILAFHTYISLILGTGEVNVAEAERLLAPFLQQFPNGSLVLFYHARIELLKGNLEEAQEVFQKCISVQEEWKQFHHLCYWELMWINVFQQNWMQAYYYSDLLCKESKWSKATYVFLKAAILSMLPEEDVVATNENVVTLFRQVDSLKQRIAGKSIPTEKFAVRKARRYSASLPAPVKLILPALEMMYVWNGFSIVSKRKDLSENLLVTVEKAEAALQSQNFNSFSVDDECLVKLLKGCCLKNLQRPLQAELCYNHVVESEKLLKYDHYLVPFTLFELASLYKSQGEIDKAIKFLETARNNYKDYSLESRLHFRIQAALHLWRKPSSD

SEQ ID NO: 66884 - protein, 669 aa, Homo sapiens
MDAVLACRLRGRGNRVAALRPRPRPGGSAGPSPFALLCAGLSPEPRAGVGSEFPAWFLGGSSQRRNMALLGSRAELEADEDVFEDALETISISSHSDMATSSLHFASCDTQQAPRQRGASTVSSSSSTKVDLKSGLEECAVALNLFLSNKFTDALELLRPWAKESMYHALGYSTIVVLQAVLTFEQQDIQNGISAMKDALQTCQKYRKKYTVVESFSSLLSRGSLEQLSEEEMHAEICYAECLLQKAALTFVQDENMINFIKGGLKIRTSYQIYKECLSILHEIQKNKLQQEFFYEFEGGVKLGSGAFNLMLSLLPARIIRLLEFIGFSGNRELGLLQLREGASGRSMRSALCCLTILAFHTYISLILGTGEVNVAEAERLLAPFLQQFPNVRSVFQSAQEVFQKCISVQEEWKQFHHLCYWELMWINVFQQNWMQAYYYSDLLCKESKWSKATYVFLKAAILSMLPEEDVVATNENVVTLFRQVDSLKQRIAGKSIPTEKFAVRKARRYSASLPAPVKLILPALEMMYVWNGFSIVSKRKDLSENLLVTVEKAEAALQSQNFNSFSVDDECLVKLLKGCCLKNLQRPLQAELCYNHVVESEKLLKYDHYLVPFTLFELASLYKSQGEIDKAIKFLETARNNYKDYSLESRLHFRIQAALHLWRKPSSD

SEQ ID NO: 66885 - protein, 682 aa, Homo sapiens
MDAVLACRLRGRGNRVAALRPRPRPGGSAGPSPFALLCAGLSPEPRAGVGSEFPAWFLGGSSQRRNMALLGSRAELEADEDVFEDALETISISSHSDMATSSLHFASCDTQQAPRQRGASTVSSSSSTKVDLKSGLEECAVALNLFLSNKFTDALELLRPWAKESMYHALGYSTIVVLQAVLTFEQQDIQNGISAMKDALQTCQKYRKKYTVVESFSSLLSRGSLEQLSEEEMHAEICYAECLLQKAALTFVQDENMINFIKGGLKIRTSYQIYKECLSILHEIQKNKLQQEFFYEFEGGVKLGSGAFNLMLSLLPARIIRLLEFIGFSGNRELGLLQLREGASGRSMRSALCCLTILAFHTYISLILGTGEVNVAEAERLLAPFLQQFPNGSLVLFYHARIELLKGNLEEAQEVFQKCISVQEEWKQFHHLCYWELMWINVFQQNWMQAYYYSDLLCKESKWSKATYVFLKAAILSMLPEEDVVATNENVVTLFRQVDSLKQRIAGKSIPTEKFAVRKARRYSASLPAPVKLILPALEMMYVWNGFSIVSKRKDLSENLLVTVEKAEAALQSQNFNSFSVDDECLVKLLKGCCLKNLQRPLQAELCYNHVVESEKLLKYDHYLVPFTLFELASLYKSQGEIDKAIKFLETARNNYKDYSLESRLHFRIQAALHLWRKPSSD

SEQ ID NO: 66886 - protein, 194 aa, Homo sapiens [sequence omitted]

SEQ ID NO: 66887 - protein, 387 aa, Homo sapiens
MEQPGQDPTSDDVMDSFLEKFQSQPYRGGFHEDQWEKEFEKVPLFMSRAPSEIDPRENPDLACLQSIIFDEERSPEEQAKTYKDEGNDYFKEKDYKKAVISYTEGLKKKCADPDLNAVLYTNRAAAQYYLGNFRSALNDVTAARKLKPCHLKAIIRGALCHLELKHFAEAVNWCDEGLQIDAKEKKLLEMRAKADKLKRIEQRDVRKANLKEKKERNQNEALLQAIKARNIRLSEAACEDEDSASEGLGELFLDGLSTENPHGARLSLDGQGRLSWPVLFLYPEYAQSDFISAFHEDSRFIDHLMVMFGETPSWDLEQKYCPDNLEVYFEDEDRAELYRVPAKSTLLQVLQHQRYFVKALTPAFLVCVGSSPFCKNFLRGRKVYQIR

SEQ ID NO: 66888 - protein, 504 aa, Homo sapiens
MATRDVVLSRVPEQEEDRTVSLQNAAAIYDLLSITLGRRGQYVMLSECLERAMKFAFGEFHLWYQVALSMVACGKSAYAVSLLRECVKLRPSDPTVPLMAAKVCIGSLRWLEEAEHFAMMVISLGEEAGEFLPKGYLALGLTYSLQATDATLKSKQDELHRKALQTLERAQQLAPSDPQVILYVSLQLALVRQISSAMEQLQEALKVRKDDAHALHLLALLFSAQKHHQHALDVVNMAITEHPENFNLMFTKVKLEQVLKGPEEALVTCRQVLRLWQTLYSFSQLGGLEKDGSFGEGLTMKKQSGMHLTLPDAHDADSGSRRASSIAASRLEEAMSELTMPSSVLKQGPMQLWTTLEQIWLQAAELFMEQQHLKEAGFCIQEAAGLFPTSHSVLYMRGRLAEVKGNLEEAKQLYKEALTVNPDGVRIMHSLGLMLSRLGHKSLAQKVLRDAVERQSTCHEAWQGLGEVLQAQGQNEAAVDCFLTALELEASSPVLPFSIIPREL

SEQ ID NO: 66889 - protein, 858 aa, Homo sapiens
MAAKGAHGSYLKVESELERCRAEGHWDRMPELVRQLQTLSMPGGGGNRRGSPSAAFTFPDTDDFGKLLLAEALLEQCLKENHAKIKDSMPLLEKNEPKMSEAKNYLSSILNHGRLSPQYMCEAMLILGKLHYVEGSYRDAISMYARAGIDDMSMENKPLYQMRLLSEAFVIKGLSLERLPNSIASRFRLTEREEEVITCFERASWIAQVFLQELEKTTNNSTSRHLKGCHPLDYELTYFLEAALQSAYVKNLKKGNIVKGMRELREVLRTVETKATQNFKVMAAKHLAGVLLHSLSEECYWSPLSHPLPEFMGKEESSFATQALRKPHLYEGDNLYCPKDNIEEALLLLLISESMATRDVVLSRVPEQEEDRTVSLQNAAAIYDLLSITLGRRGQYVMLSECLERAMKFAFGEFHLWYQVALSMVACGKSAYAVSLLRECVKLRPSDPTVPLMAAKVCIGSLRWLEEAEHFAMMVISLGEEAGEFLPKGYLALGLTYSLQATDATLKSKQDELHRKALQTLERAQQLAPSDPQVILYVSLQLALVRQISSAMEQLQEALKVRKDDAHALHLLALLFSAQKHHQHALDVVNMAITEHPENFNLMFTKVKLEQVLKGPEEALVTCRQVLRLWQTLYSFSQLGGLEKDGSFGEGLTMKKQSGMHLTLPDAHDADSGSRRASSIAASRLEEAMSELTMPSSVLKQGPMQLWTTLEQIWLQAAELFMEQQHLKEAGFCIQEAAGLFPTSHSVLYMRGRLAEVKGNLEEAKQLYKEALTVNPDGVRIMHSLGLMLSRLGHKSLAQKVLRDAVERQSTCHEAWQGLGEVLQAQGQNEAAVDCFLTALELEASSPVLPFSIIPREL

SEQ ID NO: 66890 - protein, 685 aa, Homo sapiens
KKKINFFKKPHSLSLRKKREEEVITCFERASWIAQVFLQELEKTTNNSTSRHLKGCHPLDYELTYFLEAALQSAYVKNLKKGNIVKGMRELREVLRTVETKATQNFKVMAAKHLAGVLLHSLSEECYWSPLSHPLPEFMGKEESSFATQALRKPHLYEGDNLYCPKDNIEEALLLLLISESMATRDVVLSRVPEQEEDRTVSLQNAAAIYDLLSITLGRRGQYVMLSECLERAMKFAFGEFHLWYQVALSMVACGKSAYAVSLLRECVKLRPSDPTVPLMAAKVCIGSLRWLEEAEHFAMMVISLGEEAGEFLPKGYLALGLTYSLQATDATLKSKQDELHRKALQTLERAQQLAPSDPQVILYVSLQLALVRQISSAMEQLQEALKVRKDDAHALHLLALLFSAQKHHQHALDVVNMAITEHPENFNLMFTKVKLEQVLKGPEEALVTCRQVLRLWQTLYSFSQLGGLEKDGSFGEGLTMKKQSGMHLTLPDAHDADSGSRRASSIAASRLEEAMSELTMPSSVLKQGPMQLWTTLEQIWLQAAELFMEQQHLKEAGFCIQEAAGLFPTSHSVLYMRGRLAEVKGNLEEAKQLYKEALTVNPDGVRIMHSLGLMLSRLGHKSLAQKVLRDAVERQSTCHEAWQGLGEVLQAQGQNEAAVDCFLTALELEASSPVLPFSIIPREL

SEQ ID NO: 66891 - protein, 146 aa, Homo sapiens
MAAKGAHGSYLKVESELERCRAEGHWDRMPELVRQLQTLSMPGGGGNRRGSPSAAFTFPDTDDFGKLLLAEALLEQCLKENHAKIKDSMPLLEKNEPKMSEAKNYLSSILNHGRLSGLAVLLRLVSNSWAQAILLLQPPEALGLQE

SEQ ID NO: 66892 - protein, 531 aa, Homo sapiens
MSSEMEPLLLAWSYFRRRKFQLCADLCTQMLEKSPYDQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTASMLTSPDGPFINLSRLNLTKYSQKPKLAKALFEYIFHHENDVKTIHLEDVVLHLGIYPFLLRNKNHIEKNALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 66893 - protein, 211 aa, Homo sapiens
MSSEMEPLLLAWSYFRRRKFQLCADLCTQMLEKSPYDQKISWAWWHVPVIPATWEAEAGELLEPRKRRLQQAEITPLYSSLGNKSKTPSQKAAWILKARALTEMVYIDEIDVDQEGIAEMMLDENAIAQVPRPGTSLKLPGTNQTGGPSQAANHTSWKTHYRFPQAQHAEWKARHYGTGYQNTQNRLHSPPYHQLLRKICQAGNGFHAYKS

SEQ ID NO: 66894 - protein, 505 aa, Homo sapiens
MSSEMEPLLLAWSYFRRRKFQLCADLCTQMLEKSPYDQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTASMLTSPDGPFINLSRLNLTKYSQKPKLAKALFEYIFHHENDVKTALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 66895 - protein, 475 aa, Homo sapiens
MSSEMEPLLLAWSYFRRRKFQLCADLCTQMLEKSPYDQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTALFEYIFHHENDVKTALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 66896 - protein, 250 aa, Homo sapiens
MSSEMEPLLLAWSYFRRRKFQLCADLCTQMLEKSPYDQEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 66897 - protein, 317 aa, Homo sapiens
MILSYEVILHALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 66898 - protein, 515 aa, Homo sapiens
MSSEMEPLLLAWSYFRRRKFQLCADLCTQMLEKSPYDQEPDPELPVHQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTASMLTSPDGPFINLSRLNLTKYSQKPKLAKALFEYIFHHENDVKTALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 66899 - protein, 276 aa, Homo sapiens
MYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 66900 - protein, 115 aa, Homo sapiens
MSSPSSPFREQSFLCAAGDAGEESRVQVLKNEVRRGSPVLLGWVEQAYADKCVCGPSAPPAPTPPSLSQRVMCNDLFKVNPFQLQQFRADPSTASLLLCPGGLDHKLNLRGKAWG

SEQ ID NO: 66901 - protein, 115 aa, Homo sapiens; identical to SEQ ID NO: 66900

SEQ ID NO: 66902 - protein, 504 aa, Homo sapiens
MAAQRRSLLQSEQQPSWTDDLPLCHLSGVGSASNRSYSADGKGTESHPPEDSWLKFRSENNCFLYGVFNGYDGNRVTNFVAQRLSAELLLGQLNAEHAEADVRRVLLQAFDVVERSFLESIDDALAEKASLQSQLPEGVPQHQLPPQYQKILERLKTLEREISGGAMAVVAVLLNNKLYVANVGTNRALLCKSTVDGLQVTQLNVDHTTENEDELFRLSQLGLDAGKIKQVGIICGQESTRRIGDYKVKYGYTDIDLLSAAKSKPIIAEPEIHGAQPLDGVTGFLVLMSEGLYKALEAAHGPGQANQEIAAMIDTEFAKQTSLDAVAQAVVDRVKRIHSDTFASGGERARFCPRHEDMTLLVRNFGYPLGEMSQPTPSPAPAAGGRVYPVSVPYSSAQSTSKTSVTLSLVMPSQGQMVNGAHSASTLDEATPTLTNQSPTLTLQSTNTHTQSSSSSSDGGLFRSRPAHSLPPGEDGRVEPYVDFAEFYRLWSVDHGEQSVVTAP

SEQ ID NO: 66903 - protein, 462 aa, Homo sapiens
MAAQRRSLLQSEQQPSWTDDLPLCHLSGVGSASNRSYSADGKGTESHPPEDSWLKFRSENNCFLYGVFNGYDGNRVTNFVAQRLSAELLLGQLNAEHAEADVRRVLLQAFDVVERSFLESIDDALAEKASLQSQLPEGVPQHQLPPQYQKILERLKTLEREISGGAMAVVAVLLNNKLYVANVGTNRALLCKSTVDGLQVTQLNVDHTTENEDELFRLSQLGLDAGKIKQVGIICGQESTRRIGDYKVKYGYTDIDLLSAAKSKPIIAEPEIHGAQPLDGVTGFLVLMSEGLYKALEAAHGPGQANQEIAAMIDTEFAKQTSLDAVAQAVVDRVKRIHSDTFASGGERARFCPRHEDMTLLVRNFGYPLGEMSQPTPSPAPAAGGRVYPVSVPYSSAQSTSKTSVTLSLVMPSQGQMVNGAHSASTLDEATPTLTKDPSRPASDLTAIPQCQLNLLGSLTPG

SEQ ID NO: 66904 - protein, 693 aa, Homo sapiens
MAQGSHQIDFQVLHDLRQKFPEVPEVVVSRCMLQNNNNLDACCAVLSQESTRYLYGEGDLNFSDDSGISGLRNHMTSLNLDLQSQNIYHHGREGSRMNGSRTLTHSISDGQLQGGQSNSELFQQEPQTAPAQVPQGFNVFGMSSSSGASNSAPHLGFHLGSKGTSSLSQQTPRFNPIMVTLAPNIQTGRNTPTSLHIHGVPPPVLNSPQGNSIYIRPYITTPGGTTRQTQQHSGWVSQFNPMNPQQVYQPSQPGPWTTCPASNPLSHTSSQQPNQQGHQTSHVYMPISSPTTSQPPTIHSSGSSQSSAHSQYNIQNISTGPRKNQIEIKLEPPQRNNSSKLRSSGPRTSSTSSSVNSQTLNRNQPTVYIAASPPNTDELMSRSQPKVYISANAATGDEQVMRNQPTLFISTNSGASAASRNMSGQVSMGPAFIHHHPPKSRAIGNNSATSPRVVVTQPNTKYTFKITVSPNKPPAVSPGVVSPTFELTNLLNHPDHYVETENIQHLTDPTLAHVDRISETRKLSMGSDDAAYTQALLVHQKARMERLQRELEIQKKKLDKLKSEVNEMENNLTRRRLKRSNSISQIPSLEEMQQLRSCNRQLQIDIDCLTKEIDLFQARGPHFNPSAIHNFYDNIGFVGPVPPKPKDQRSIIKTPKTQDTEDDEGAQWNCTACTFLNHPALIRCEQCEMPRHF

SEQ ID NO: 66905 - protein, 693 aa, Homo sapiens; identical to SEQ ID NO: 66904

SEQ ID NO: 66906 - protein, 536 aa, Homo sapiens
MAQGSHQIDFQVLHDLRQKFPEVPEVVVSRCMLQNNNNLDACCAVLSQESTRYLYGEGDLNFSDDSGISGLRNHMTSLNLDLQSQNIYHHGREGSRMNGSRTLTHSISDGQLQGGQSNSELFQQEPQTAPAQVPQGFNVFGMSSSSGASNSAPHLGFHLGSKGTSSLSQQTPRFNPIMVTLAPNIQTGRNTPTSLHIHGVPPPVLNSPQGNSIYIRPYITTPGGTTRQTQQHSGWVSQFNPMNPQQVYQPSQPGPWTTCPASNPLSHTSSQQPNQQGHQTSHVYMPISSPTTSQPPTIHSSGSSQSSAHSQYNIQNISTGPRKNQIEIKLEPPQRNNSSKLRSSGPRTSSTSSSVNSQTLNRNQPTVYIAASPPNTDELMSRSQPKVYISANAATGDEQVMRNQPTLFISTNSGASAASRNMSGQVSMGPAFIHHHPPKSRAIGNNSATSPRVVVTQPNTKYTFKITVSPNKPPAVSPGVVSPTFELTNLLNHPDHYVETENIQHLTDPTLAHVDRISETRKLSMGSDDAAYTQDI

SEQ ID NO: 66907 - protein, 661 aa, Homo sapiens
MQNNNNLDACCAVLSQESTRYLYGEGDLNFSDDSGISGLRNHMTSLNLDLQSQNIYHHGREGSRMNGSRTLTHSISDGQLQGGQSNSELFQQEPQTAPAQVPQGFNVFGMSSSSGASNSAPHLGFHLGSKGTSSLSQQTPRFNPIMVTLAPNIQTGRNTPTSLHIHGVPPPVLNSPQGNSIYIRPYITTPGGTTRQTQQHSGWVSQFNPMNPQQVYQPSQPGPWTTCPASNPLSHTSSQQPNQQGHQTSHVYMPISSPTTSQPPTIHSSGSSQSSAHSQYNIQNISTGPRKNQIEIKLEPPQRNNSSKLRSSGPRTSSTSSSVNSQTLNRNQPTVYIAASPPNTDELMSRSQPKVYISANAATGDEQVMRNQPTLFISTNSGASAASRNMSGQVSMGPAFIHHHPPKSRAIGNNSATSPRVVVTQPNTKYTFKITVSPNKPPAVSPGVVSPTFELTNLLNHPDHYVETENIQHLTDPTLAHVDRISETRKLSMGSDDAAYTQALLVHQKARMERLQRELEIQKKKLDKLKSEVNEMENNLTRRRLKRSNSISQIPSLEEMQQLRSCNRQLQIDIDCLTKEIDLFQARGPHFNPSAIHNFYDNIGFVGPVPPKPKDQRSIIKTPKTQDTEDDEGAQWNCTACTFLNHPALIRCEQCEMPRHF

SEQ ID NO: 66908 - protein, 693 aa, Homo sapiens; identical to SEQ ID NO: 66904

SEQ ID NO: 66909 - protein, 237 aa, Homo sapiens
MSDSDLGEDEGLLSLAGKRKRRGNLPKESVKILRDWLYLHRYNAYPSEQEKLSLSGQTNLSVLQICNWFINARRRLLPDMLRKDGKDPNQFTISRRGGKASDVALPRGSSPSVLAVSVPAPTNVLSLSVCSMPLHSGQGEKPAAPFPRGELESPKPLVTPGSTLTLLTRAEAGSPTGGLFNTPPPTPPEQDKEDFSSFQLLVEVALQRAAEMELQKQQDPSLPLLHTPIPLVSENPQ

SEQ ID NO: 66910 - protein, 237 aa, Homo sapiens; identical to SEQ ID NO: 66909

SEQ ID NO: 66911 - protein, 174 aa, Homo sapiens
MSDSDLGEDEGLLSLAGKRKRRGNLPKESVKILRDWLYLHRYNAYPSEQEKLSLSGQTNLSVLQICNWFINARRRLLPDMLRKDGKDPNQFTISRRGGKASDVALPRGSSPSVLAVSVPAPTNVLSLSVCSMPLHSGQGEKPAAPFPRGELESPKPLVTPGSTLTLLTRAEAGS

SEQ ID NO: 66912 - protein, 237 aa, Homo sapiens; identical to SEQ ID NO: 66909

SEQ ID NO: 66913 - protein, 241 aa, Homo sapiens
MEAAADGPAETQSPVEKDSPAKTQSPAQDTSIMSRNNADTGRVLALPEHKKKRKGNLPAESVKILRDWMYKHRFKAYPSEEEKQMLSEKTNLSLLQISNWFINARRRILPDMLQQRRNDPIIGHKTGKDAHATHLQSTEASVPAKSGPSGPDNVQSLPLWPLPKGQMSREKQPDPESAPSQKLTGIAQPKKKVKVSVTSPSSPELVSPEEHADFSSFLLLVDAAVQRAAELELEKKQEPNP

SEQ ID NO: 66914 - protein, 241 aa, Homo sapiens; identical to SEQ ID NO: 66913

SEQ ID NO: 66915 - protein, 185 aa, Homo sapiens
MEAAADGPAETQSPVEKDSPAKTQSPAQDTSIMSRNNADTGRVLALPEHKKKRKGNLPAESVKILRDWMYKHRFKAYPSEEEKQMLSEKTNLSLLRISNWFINARRRILPDMLQQRRNDPIIGHKTGKDAHATHLQSTEASVPAKSGPVVQTMYKACPCGPCQRARCQERSNQIRSRPLARSSPE

SEQ ID NO: 66916 - protein, 185 aa, Homo sapiens; identical to SEQ ID NO: 66915

SEQ ID NO: 66917 - protein, 590 aa, Homo sapiens
MAGAVPGAIMDEDYYGSAAEWGDEADGGQQEDDSGEGEDDAEVQQECLHKFSTRDYIMEPSIFNTLKRYFQAGGSPENVIQLLSENYTAVAQTVNLLAEWLIQTGVEPVQVQETVENHLKSLLIKHFDPRKADSIFTEEGETPAWLEQMIAHTTWRDLFYKLAEAHPDCLMLNFTVKLISDAGYQGEITSVSTACQQLEVFSRVLRTSLATILDGGEENLEKNLPEFAKMVCHGEHTYLFAQAMMSVLAQEEQGGSAVRRIAQEVQRFAQEKGHDASQITLALGTAASYPRACQALGAMLSKGALNPADITVLFKMFTSMDPPPVELIRVPAFLDLFMQSLFKPGARINQDHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCHQLLHPQVLQLLVKLFETEHSQLDVMEQLELKKTLLDRMVHLLSRGYVLPVVSYIRKCLEKLDTDISLIRYFVTEVLDVIAPPYTSDFVQLFLPILENDSIAGTIKTEGEHDPVTEFIAHCKSNFIMVN

SEQ ID NO: 66918 - protein, 590 aa, Homo sapiens; identical to SEQ ID NO: 66917

SEQ ID NO: 66919 - protein, 257 aa, Homo sapiens
MPARCVAAHCGNTTKSGKSLFRFPKDRAVRLLWDRFVRGCRADWYGGNDRSVICSDHFAPACFDVSSVIQKNLRFSQRLRLVAGAVPTLHRVPAPAPKRGEEGDQAGRLDTRGELQAARHSEAAPGPVSCTRPRAGKQAAASQITCENELVQTQPHADNPSNTVTSVPTHCEEGPVHKSTQISLKRPRHRSVGIQAKVKAFGKRLCNATTQTEELWSRTSSLFDIYSSDSETDTDWDIKSEQSDLSYMAVQVKEETC

SEQ ID NO: 66920 - protein, 165 aa, Homo sapiens
MEPPKMNPVVEPLSWMLGTWLSDPPGAGTYPTLQPFQYLEEVHISHVGQPMLNFSFNSFHPDTRKPMHRECGFIRLKPDTNKVAFVSAQNTGVVEVEEGEVNGQELCIASHSIARISFAKEPHVEQITRKFRLNSEGKLEQTVSMATTTQPMTQHLHVTYKKVTP

SEQ ID NO: 66921 - protein, 577 aa, Homo sapiens
MVICCAAVNCSNRQGKGEKRAVSFHRFPLKDSKRLIQWLKAVQRDNWTPTKYSFLCSEHFTKDSFSKRLEDQHRLLKPTAVPSIFHLTEKKRGAGGHGRTRRKDASKATGGVRGHSSAATSRGAAGWSPSSSGNPMAKPESRRLKQAALQGEATPRAAQEAASQEQAQQALERTPGDGLATMVAGSQGKAEASATDAGDESATSSIEGGVTDKSGISMDDFTPPGSGACKFIGSLHSYSFSSKHTRERPSVPREPIDRKRLKKDVEPSCSGSSLGPDKGLAQSPPSSSLTATPQKPSQSPSAPPADVTPKPATEAVQSEHSDASPMSINEVILSASGACKLIDSLHSYCFSSRQNKSQVCCLREQVEKKNGELKSLRQRVSRSDSQVRKLQEKLDELRRVSVPYPSSLLSPSREPPKMNPVVEPLSWMLGTWLSDPPGAGTYPTLQPFQYLEEVHISHVGQPMLNFSFNSFHPDTRKPMHRECGFIRLKPDTNKVAFVSAQNTGVVEVEEGEVNGQELCIASHSIARISFAKEPHVEQITRKFRLNSEGKLEQTVSMATTTQPMTQHLHVTYKKVTP

SEQ ID NO: 66922 - protein, 169 aa, Homo sapiens [sequence omitted]

SEQ ID NO: 66923 - protein, 353 aa, Homo sapiens
MKRDSWVPSKYQFLCSDHFTPDSLDIRWGIRYLKQTAVPTIFSLPEDNQGKDPSKKKSQKKNLEDEKEVCPKAKSEESFVLNETKKNIVNTDVPHQHPELLHSSSLVKPPAPKTGSIQNNMLTLNLVKQHTGKPESTLETSVNQDTGRGGFHTCFENLNSTTITLTTSNSESIHQSLETQEVLEVTTSHLANPNFTSNSMEIKSAQENPFLFSTINQTVEELNTNKESVIAIFVPAENSKPSVNSFISAQKETTEMEDTDIEDSLYKDVDYGTEVLQIEHSYCRQDINKEHLWQKVSKLHSKITLLELKEQQTLGRLKSLEALIRQLKQENWLSEENVKIIENHFTTYEVTMI

SEQ ID NO: 66924 - protein, 395 aa, Homo sapiens
MPRYCAAICCKNRRGRNNKDRKLSFYPFPLHDKERLEKWLKNMKRDSWVPSKYQFLCSDHFTPDSLDIRWGIRYLKQTAVPTIFSLPEDNQGKDPSKKKSQKKNLEDEKEVCPKAKSEESFVLNETKKNIVNTDVPHQHPELLHSSSLVKPPAPKTGSIQNNMLTLNLVKQHTGKPESTLETSVNQDTGRGGFHTCFENLNSTTITLTTSNSESIHQSLETQEVLEVTTSHLANPNFTSNSMEIKSAQENPFLFSTINQTVEELNTNKESVIAIFVPAENSKPSVNSFISAQKETTEMEDTDIEDSLYKDVDYGTEVLQIEHSYCRQDINKEHLWQKVSKLHSKITLLELKEQQTLGRLKSLEALIRQLKQENWLSEENVKIIENHFTTYEVTMI

SEQ ID NO: 66925 - protein, 222 aa, Homo sapiens
MVKCCSAIGCASRCLPNSKLKGLTFHVFPTDENIKRKWVLAMKRLDVNAAGIWEPKKGDVLCSRHFKKTDFDRSAPNIKLKPGVIPSIFDSPYHLQGKREKLHCRKNFTLKTVPATNYNHHLVGASSCIEEFQSQFIFEHSYSVMDSPKKLKHKLDHVIGELEDTKESLRNVLDREKRFQKSLRKTIRELKDECLISQETANRLDTFCWDCCQESIEQDYIS

SEQ ID NO: 66926 - protein, 32 aa, Homo sapiens
MVKCCSAIGCASRCLPNSKLKGLTFHVFPTDE

SEQ ID NO: 66927 - protein, 80 aa, Homo sapiens
MVKCCSAIGCASRCLPNSKLKGLTFHVFPTDENIKRKWVLAMKRLDVNAAGIWEPKKGDVLCSRHFKKTDFDRSAPNIKL

SEQ ID NO: 66928 - protein, 222 aa, Homo sapiens; identical to SEQ ID NO: 66925

SEQ ID NO: 66929 - protein, 274 aa, Homo sapiens
MPKYCRAPNCSNTAGRLGADNRPVSFYKFPLKDGPRLQAWLQHMGCEHWVPSCHQHLCSEHFTPSCFQWRWGVRYLRPDAVPSIFSRGPPAKSQRRTRSTQKPVSPPPPLQKNTPLPQSPAIPVSGPVRLVVLGPTSGSPKTVATMLLTPLAPAPTPERSQPEVPAQQAQTGLGPVLGALQRRVRRLQRCQERHQAQLQALERLAQQLHGESLLARARRGLQRLTTAQTLGPEESQTFTIICGGPDIAMVLAQDPAPATVDAKPELLDTRIPSA

SEQ ID NO: 66930 - protein, 274 aa, Homo sapiens; identical to SEQ ID NO: 66929

SEQ ID NO: 66931 - protein, 129 aa, Homo sapiens
MLLTPLAPAPTPERSQPEVPAQQAQTGLGPVLGALQRRVRRLQRCQERHQAQLQALERLAQQLHGESLLARARRGLQRLTTAQTLGPEESQTFTIICGGPDIAMVLAQDPAPATVDAKPELLDTRIPSA

SEQ ID NO: 66932 - protein, 903 aa, Homo sapiens
MTRSCSAVGCSTRDTVLSRERGLSFHQFPTDTIQRSKWIRAVNRVDPRSKKIWIPGPGAILCSKHFQESDFESYGIRRKLKKGAVPSVSLYKIPQGVHLKGKARQKILKQPLPDNSQEVATEDHNYSLKTPLTIGAEKLAEVQQMLQVSKKRLISVKNYRMIKKRKGLRLIDALVEEKLLSEETECLLRAQFSDFKWELYNWRETDEYSAEMKQFACTLYLCSSKVYDYVRKILKLPHSSILRTWLSKCQPSPGFNSNIFSFLQRRVENGDQLYQYCSLLIKSMPLKQQLQWDPSSHSLQGFMDFGLGKLDADETPLASETVLLMAVGIFGHWRTPLGYFFVNRASGYLQAQLLRLTIGKLSDIGITVLAVTSDATAHSVQMAKALGIHIDGDDMKCTFQHPSSSSQQIAYFFDSCHLLRLIRNAFQNFQSIQFINGIAHWQHLVELVALEEQELSNMERIPSTLANLKNHVLKVNSATQLFSESVASALEYLLSLDLPPFQNCIGTIHFLRLINNLFDIFNSRNCYGKGLKGPLLPETYSKINHVLIEAKTIFVTLSDTSNNQIIKGKQKLGFLGFLLNAESLKWLYQNYVFPKVMPFPYLLTYKFSHDHLELFLKMLRQVLVTSSSPTCMAFQKAYYNLETRYKFQDEVFLSKVSIFDISIARRKDLALWTVQRQYGVSVTKTVFHEEGICQDWSHCSLSEALLDLSDHRRNLICYAGYVANKLSALLTCEDCITALYASDLKASKIGSLLFVKKKNGLHFPSESLCRVINICERVVRTHSRMAIFELVSKQRELYLQQKILCELSGHINLFVDVNKHLFDGEVCAINHFVKLLKDIIICFLNIRAKNVAQNPLKHHSERTDMKTLSRKHWSSVQDYKCSSFANTSSKFRHLLSNDGYPFK

SEQ ID NO: 66933 - protein, 903 aa, Homo sapiens; identical to SEQ ID NO: 66932

SEQ ID NO: 66934 - protein, 213 aa, Homo sapiens
MVQSCSAYGCKNRYDKDKPVSFHKFPLTRPSLCKEWEAAVRRKNFKPTKYSSICSEHFTPDCFKRECNNKLLKENAVPTIFLCTEPHDKKEDLLEPQEQLPPPPLPPPVSQVDAAIGLLMPPLQTPVNLSVFCDHNYTVEDTMHQRKRIHQLEQQVEKLRKKLKTAQQRCRRQERQLEKLKEVVHFQKEKDDVSERGYVILPNDYFEIVEVPA

SEQ ID NO: 66935 - protein, 53 aa, Homo sapiens
MVQSCSAYGCKNRYDKDKPVSFHKKKIFWSHRNSFPHLLYRLLFPRLMLLLDY

SEQ ID NO: 66936 - protein, 228 aa, Homo sapiens
MPTNCAAAGCATTYNKHINISFHRFPLDPKRRKEWVRLVRRKNFVPGKHTFLCSKHFEASCFDLTGQTRRLKMDAVPTIFDFCTHIKSMKLKSRNLLKKNNSCSPAGPSNLKSNISSQQVLLEHSYAFRNPMEAKKRIIKLEKEIASLRRKMKTCLQKERRATRRWIKATCLVKNLEANSVLPKGTSEHMLPTALSSLPLEDFKILEQDQQDKTLLSLNLKQTKSTFI

SEQ ID NO: 66937 - protein, 239 aa, Homo sapiens
MPKSCAARQCCNRYSSRRKQLTFHRFPFSRPELLKEWVLNIGRGNFKPKQHTVICSEHFRPECFSAFGNRKNLKHNAVPTVFAFQDPTQQVRENTDPASERGNASSSQKEKVLPEAGAGEDSPGRNMDTALEELQLPPNAEGHVKQVSPRRPQATEAVGRPTGPAGLRRTPNKQPSDHSYALLDLDSLKKKLFLTLKENEKLRKRLQAQRLVMRRMSSRLRACKGHQGLQARLGPEQQS

SEQ ID NO: 66938 - protein, 238 aa, Homo sapiens
MPKSCAARQCCNRYSSRRKQLTFHRFPFSRPELLKEWVLNIGRGNFKPKQHTVICSEHFRPECFSAFGNRKNLKHNAVPTVFAFQDPTQVRENTDPASERGNASSSQKEKVLPEAGAGEDSPGRNMDTALEELQLPPNAEGHVKQVSPRRPQATEAVGRPTGPAGLRRTPNKQPSDHSYALLDLDSLKKKLFLTLKENEKLRKRLQAQRLVMRRMSSRLRACKGHQGLQARLGPEQQS

SEQ ID NO: 66939 - protein, 175 aa, Homo sapiens
MPKSCAARQCCNRYSSRRKQLTFHRFPFSRPELLKEWVLNIGRGNFKPKQHTVICSEHFRPECFSAFGNRKNLKHNAVPTVFAFQDPTQQVRENTDPASERGNASSSQKEKTSPCRSQVLPEAGAGEDSPGRNMDTALEELQLPPNAEGHVKQAMLFNVENGTPASREALWLSEE

SEQ ID NO: 66940 - protein, 243 aa, Homo sapiens [sequence omitted]

SEQ ID NO: 66941 - protein, 194 aa, Homo sapiens
MEHAFTPLEPLLSTGNLKYCLVILNQPLDNYFRHLWNKALLRACADGGANRLYDITEGERESFLPEFINGDFDSIRPEVREYYATKGCELISTPDQDHTDFTKCLKMLQKKIEEKDLKGKHRLHVDTGMEGDWCGLIPVGQPCMQVTTTGLKWNLTNDVLAFGTLVSTSNTYDGSGVVTVETDHPLLWTMAIKS

SEQ ID NO: 66942 - protein, 124 aa, Homo sapiens
MVDVIVTLGGLAGRFDQIMASVNTLFQATHITPFPIIIIQEESLIYLLQPGKHRLHVDTGMEGDWCGLIPVGQPCMQVTTTGLKWNLRTCDYTRTTWIAKDNPVPRLIRLIRLNHICKVPLAIK

SEQ ID NO: 66943 - protein, 167 aa, Homo sapiens
MEHAFTPLEPLLSTGNLKYCLVILNQPLDNYFRHLWNKALLRACADGGANRLYDITEGERESFLPEFINGDFDSIRPEVREYYATKGCELISTPDQDHTDFTKCLKMLQKKIEEKDLKVDVIVTLGGLAGRFDQIMASVNTLFQATHITPFPIIIIQEESLIYLLQP

SEQ ID NO: 66944 - protein, 230 aa, Homo sapiens
MAQGLIEVERKFLPGPGTEERLQELGGTLEYRVTFRDTYYDTPELSLMQADHWLRRREDSGWELKCPGAAGVLGPHTEYKELTAEPTIVAQLCKVLRADGLGAGDVAAVLGPLGLQEVASFVTKRSAWKLVLLGADEEEPQLRVDLDTADFGYAVGEVEALVHEEAEVPTALEKIHRLSSMLGVPAQETAPAKLIVYLQRFRPQDYQRLLEVNSSRERPQETEDPDHCLG

SEQ ID NO: 66945 - protein, 230 aa, Homo sapiens; identical to SEQ ID NO: 66944

SEQ ID NO: 66946 - protein, 123 aa, Homo sapiens
MAQGLIEVERKFLPGPGTEERLQELGGTLEYRVTFRDTYYDTPELSLMQADHWLRRREDSGWELKCPGAAGVLGPHTEYKELTAEPTIVAQLCKVLRADGLGAGDVAAVLGPLGLQEVASFVT

SEQ ID NO: 66947 - protein, 689 aa, Homo sapiens
MKPPAACAGDMADAASPCSVVNDLRWDLSAQQIEERTRELIEQTKRVYDQVGTQEFEDVSYESTLKALADVEVTYTVQRNILDFPQHVSPSKDIRTASTEADKKLSEFDVEMSMREDVYQRIVWLQEKVQKDSLRPEAARYLERLIKLGRRNGLHLPRETQENIKRIKKKLSLLCIDFNKNLNEDTTFLPFTLQELGGLPEDFLNSLEKMEDGKLKVTLKYPHYFPLLKKCHVPETRRKVEEAFNCRCKEENCAILKELVTLRAQKSRLLGFHTHADYVLEMNMAKTSQTVATFLDELAQKLKPLGEQERAVILELKRAECERRGLPFDGRIRAWDMRYYMNQVEETRYCVDQNLLKEYFPVQVVTHGLLGIYQELLGLAFHHEEGASAWHEDVRLYTARDAASGEVVGKFYLDLYPREGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKVGMDYRSCILRPGGSEDASAMLRRFLGRDPKQDAFLLSKGLQVGGCEPEPQVC

SEQ ID NO: 66948 - protein, 258 aa, Homo sapiens
MFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKFPHYEVRPLRHVSLCLPLTWCDPGSGQPPESLTRNRWLPALRAGPALPGCNIALGSLQVGMDYRSCILRPGGSEDASAMLRRFLGRDPKQDAFLLSKGLQVGGCEPEPQVC

SEQ ID NO: 66949 - protein, 245 aa, Homo sapiens
MDGTRTSLDIEEYSDTEVQKNQVLTLEEWQDKWVNGKTAFHQEQGHQLLKKHLDTFLKGKSGLRVFFPLCGKAVEMKWFADRGHSVVGVEISELGIQEFFTEQNLSYSEEPITEIPGTKVFKSSSGNISLYCCSIFDLPRTNIGKFDMIWDRGALVAINPGDRKCYADTMFSLLGKKFQYLLCVLSYDPTKHPGPPFYVPHAEIERLFGKICNIRCLEKVDAFEERHKSWGIDCLFEKLYLLTEK

SEQ ID NO: 66950 - protein, 172 aa, Homo sapiens
METRPRLGATCLLGFSFLLLVISSDGHNGLGKGFGDHIHWRTLEDGKKEAAASGLPLMVIIHKSWCGACKALKPKFAESTEISELSHNFVMVNLEDEEEPKDEDFSPDGGYIPRILFLDPSGKVHPEIINENGNPSYKYFYVSAEQVVQGMKEAQERLTGDAFRKKHLEDEL

SEQ ID NO: 66951 - protein, 588 aa, Homo sapiens
MASKKREVQLQTVINNQSLWDEMLQNKGLTVIDVYQAWCGPCRAMQPLFRKLKNELNEDEILHFAVAEADNIVTLQPFRDKCEPVFLFSVNGKIIEKIQGANAPLVNKKVINLIDEERKIAAGEMARPQYPEIPLVDSDSEVSEESPCESVQELYSIAIIKPDAVISKKVLEIKRKITKAGFIIEAEHKTVLTEEQVVNFYSRIADQCDFEEFVSFMTSGLSYILVVSQGSKHNPPSEETEPQTDTEPNERSEDQPEVEAQVTPGMMKNKQDSLQEYLERQHLAQLCDIEEDAANVAKFMDAFFPDFKKMKSMKLEKTLALLRPNLFHERKDDVLRIIKDEDFKILEQRQVVLSEKEAQALCKEYENEDYFNKLIENMTSGPSLALVLLRDNGLQYWKQLLGPRTVEEAIEYFPESLCAQFAMDSLPVNQLYGSDSLETAEREIQHFFPLQSTLGLIKPHATSEQREQILKIVKEAGFDLTQVKKMFLTPEQIEKIYPKVTGKDFYKDLLEMLSVGPSMVMILTKWNAVAEWRRLMGPTDPEEAKLLSPDSIRAQFGISKLKNIVHGASNAYEAKEVVNRLFEDPEEN

SEQ ID NO: 66952 - protein, 588 aa, Homo sapiens; identical to SEQ ID NO: 66951

SEQ ID NO: 66953 - protein, 226 aa, Homo sapiens
MEADASVDMFSKVLEHQLLQTTKLVEEHLDSEIQKLDQMDEDELERLKEKRLQALRKAQQQKQEWLSKGHGEYREIPSERDFFQEVKESENVVCHFYRDSTFRCKILDRHLAILSKKHLETKFLKLNVEKAPFLCERLHIKVIPTLALLKDGKTQDYVVGFTDLGNTDDFTTETLEWRLGSSDILNYSGNLMEPPFQNQKKFGTNFTKLEKKTIRGKKYDSDSDDD

SEQ ID NO: 66954 - protein, 135 aa, Homo sapiens
MEADASVDMFSKVLEHQLLQTTKLVEEHLDSEIQKLDQMDEDELERLKEKRLQALRKAQQQKQEWLSKGHGEYREIPSERDFFQEVKESENVVCHFYRDSTFRCKILDRHLAILSKKHLETKFLKLNVEKAPFLC

SEQ ID NO: 66955 - protein, 208 aa, Homo sapiens
MSQKSLAPRLNSVPFGRMEADASVDMFSKVLEHQLLQTTKLVEEHLDSEIQKLDQMDEDELERLKEKRLQALRKAQQQKQEWLSKGHGEYREIPSERDFFQEVKESENVVCHFYRDSTFRCKILDRHLAILSKKHLETKFLKLNVEKAPFLCERLHIKVIPTLALLKDGKTQDYVVGFTDLGNTDDFTTETLEWRLGSSDILNYRWWP

SEQ ID NO: 66956 - protein, 338 aa, Homo sapiens
MAAMAVALRGLGGRFRWRTQAVAGGVRGAARGAAAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIAPCISACLPTTVGHAGKNQRRD

SEQ ID NO: 66957 - protein, 494 aa, Homo sapiens
  MOD_RES (493)..(493): Selenocysteine
MEDQAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCCG

SEQ ID NO: 66958 - protein, 524 aa, Homo sapiens
  MOD_RES (523)..(523): Selenocysteine
MAAMAVALRGLGGRFRWRTQAVAGGVRGAARGAAAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCCG

SEQ ID NO: 66959 - protein, 521 aa, Homo sapiens
MAAMAVALRGLGGRFRWRTQAVAGGVRGAARGAAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGC

SEQ ID NO: 66960 - protein, 522 aa, Homo sapiens
MAAMAVALRGLGGRFRWRTQAVAGGVRGAARGAAAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLPVSVSYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGC

SEQ ID NO: 66961 - protein, 426 aa, Homo sapiens
MHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTCVVAHAYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGC

SEQ ID NO: 66962 - protein, 492 aa, Homo sapiens
MEDQAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGC

SEQ ID NO: 66963 - protein, 142 aa, Homo sapiens
MSYMLPHLHNGWQVDQAILSEEDRVVVIRFGHDWDPTCMKMDEVLYSIAEKVKNFAVIYLVDITEVPDFNKMYELYDPCTVMFFFRNKHIMIDLGTGNNNKINWAMEDKQEMVDIIETVYRGARKGRGLVVSPKDYSTKYRY

SEQ ID NO: 66964 - protein, 91 aa, Homo sapiens
MSYMLPHLHNGWQVDQAILSEEDRVVVIRFGHDWDPTCMKMDEVLYSIAEKVKNFAVIYLVDITEVPDFNKMYELYDPCTVMFFFSYHRGW

SEQ ID NO: 66965 - protein, 297 aa, Homo sapiens
MVHQVLYRALVSTKWLAESIRTGKLGPGLRVLDASWYSPGTREARKEYLERHVPGASFFDIEECRDTASPYEMMLPSEAGFAEYVGRLGISNHTHVVVYDGEHLGSFYAPRVWWMFRVFGHRTVSVLNGGFRNWLKEGHPVTSEPSRPEPAVFKATLDRSLLKTYEQVLENLESKRFQLVDSRSQGRFLGTEPEPDAVGLDSGHIRGAVNMPFMDFLTEDGFEKGPEELRALFQTKKVDLSQPLIATCRKGVTACHVALAAYLCGKPDVAVYDGSWSEWFRRAPPESRVSQGKSEKA

SEQ ID NO: 66966 - protein, 297 aa, Homo sapiens; identical to SEQ ID NO: 66965

SEQ ID NO: 66967 - protein, 244 aa, Homo sapiens
MVHQVLYRALVSTKWLAESIRTGKLGPGLRVLDASWYSPGTREARKEYLERHVPGASFFDIEECRDTASPYEMMLPSEAGFAEYVGRLGISNHTHVVVYDGEHLGSFYAPRVWWMFRVFGHRTVSVLNGGFRNWLKEGHPVTSEPSRPEPAVFKATLDRSLLKTYEQVLENLESKRFQLVDSRSQGRFLGTEPEPDAVGLDSGHIRGAVNMPFMDFLTEDGSWSEWFRRAPPESRVSQGKSEKA

SEQ ID NO: 66968 - protein, 124 aa, Homo sapiens
MVHQVLYRALVSTKWLAESIRTGKLGPGLRVLDASWYSPGTREARKEYLERHVPGASFFDIEECRDTASPYEMMLPSEAGFAEYVGRLGISNHTHVVVYDGEHLGSFYAPRVWWMFRVFGHRTV

SEQ ID NO: 66969 - protein, 657 aa, Homo sapiens
MSPTPPLFSLPEARTRFTKSTREALNNKNIKPLLSTFSQVPGSENEKKCTLDQAFRGILEEEIINHSSCENVLAIISLAIGGVTEGICTASTPFVLLGDVLDCLPLDQCDTIFTFVEKNVATWKSNTFYSAGKNYLLRMCNDLLRRLSKSQNTVFCGRIQLFLARLFPLSEKSGLNLQSQFNLENVTVFNTNEQESTLGQKHTEDREEGMDVEEGEMGDEEAPTTCSIPIDYNLYRKFWSLQDYFRNPVQCYEKISWKTFLKYSEEVLAVFKSYKLDDTQASRKKMEELKTGGEHVYFAKFLTSEKLMDLQLSDSNFRRHILLQYLILFQYLKGQVKFKSSNYVLTDEQSLWIEDTTKSVYQLLSENPPDGERFSKMVEHILNTEENWNSWKNEGCPSFVKERTSDTKPTRIIRKRTAPEDFLGKGPTKKILMGNEELTRLWNLCPDNMEACKSETREHMPTLEEFFEEAIEQADPENMVENEYKAVNNSNYGWRALRLLARRSPHFFQPTNQQFKSLPEYLENMVIKLAKELPPPSEEIKTGEDEDEEDNDALLKENESPDVRRDKPVTGEQIEVFANKLGEQWKILAPYLEMKDSEIRQIECDSEDMKMRAKQLLVAWQDQEGVHATPENLINALNKSGLSDLAESLTNDNETNS

SEQ ID NO: 66970 - protein, 1593 aa, Homo sapiens
MAAAAVVVPAEWIKNWEKSGRGEFLHLCRILSENKSHDSSTYRDFQQALYELSYHVIKGNLKHEQASNVLSDISEFREDMPSILADVFCILDIETNCLEEKSKRDYFTQLVLACLYLVSDTVLKERLDPETLESLGLIKQSQQFNQKSVKIKTKLFYKQQKFNLLREENEGYAKLIAELGQDLSGSITSDLILENIKSLIGCFNLDPNRVLDVILEVFECRPEHDDFFISLLESYMSMCEPQTLCHILGFKFKFYQEPNGETPSSLYRVAAVLLQFNLIDLDDLYVHLLPADNCIMDEHKREIAEAKQIVRKLTMVVLSSEKMDEREKEKEKEEEKVEKPPDNQKLGLLEALLKIGDWQHAQNIMDQMPPYYAASHKLIALAICKLIHITIEPLYRRVGVPKGAKGSPVNALQNKRAPKQAESFEDLRRDVFNMFCYLGPHLSHDPILFAKVVRIGKSFMKEFQSDGSKQEDKEKTEVILSCLLSITDQVLLPSLSLMDCNACMSEELWGMFKTFPYQHRYRLYGQWKNETYNSHPLLVKVKAQTIDRAKYIMKRLTKENVKPSGRQIGKLSHSNPTILFDYILSQIQKYDNLITPVVDSLKYLTSLNYDVLAYCIIEALANPEKERMKHDDTTISSWLQSLASFCGAVFRKYPIDLAGLLQYVANQLKAGKSFDLLILKEVVQKMAGIEITEEMTMEQLEAMTGGEQLKAEGGYFGQIRNTKKSSQRLKDALLDHDLALPLCLLMAQQRNGVIFQEGGEKHLKLVGKLYDQCHDTLVQFGGFLASNLSTEDYIKRVPSIDVLCNEFHTPHDAAFFLSRPMYAHHISSKYDELKKSEKGSKQQHKVHKYITSCEMVMAPVHEAVVSLHVSKVWDDISPQFYATFWSLTMYDLAVPHTSYEREVNKLKVQMKAIDDNQEMPPNKKKKEKERCTALQDKLLEEEKKQMEHVQRVLQRLKLEKDNWLLAKSTKNETITKFLQLCIFPRCIFSAIDAVYCARFVELVHQQKTPNFSTLLCYDRVFSDIIYTVASCTENEASRYGRFLCCMLETVTRWHSDRATYEKECGNYPGFLTILRATGFDGGNKADQLDYENFRHVVHKWHYKLTKASVHCLETGEYTHIRNILIVLTKILPWYPKVLNLGQALERRVHKICQEEKEKRPDLYALAMGYSGQLKSRKSYMIPENEFHHKDPPPRNAVASVQNGPGGGPSSSSIGSASKSDESSTEETDKSRERSQCGVKAVNKASSTTPKGNSSNGNSGSNSNKAVKENDKEKGKEKEKEKKEKTPATTPEARVLGKDGKEKPKEERPNKDEKARETKERTPKSDKEKEKFKKEEKAKDEKFKTTVPNAESKSTQEREREKEPSRERDIAKEMKSKENVKGGEKTPVSGSLKSPVPRSDIPEPEREQKRRKIDTHPSPSHSSTVKDSLIELKESSAKLYINHTPPPLSKSKEREMDKKDLDKSRERSREREKKDEKDRKERKRDHSNNDREVPPDLTKRRKEENGTMGVSKHKSESPCESPYPNEKDKEKNKSKSSGKEKGSDSFKSEKMDKISSGGKKESRHDKEKIEKKEKRDSSGGKEEKKHHKSSDKHR

SEQ ID NO: 66971 - protein, 1593 aa, Homo sapiens; identical to SEQ ID NO: 66970

SEQ ID NO: 66972 - protein, 848 aa, Homo sapiens
MPSILADVFCILDIETNCLEEKSKRDYFTQLVLACLYLVSDTVLKERLDPETLESLGLIKQSQQFNQKSVKIKTKLFYKQQKFNLLREENEGYAKLIAELGQDLSGSITSDLILENIKSLIGCFNLDPNRVLDVILEVFECRPEHDDFFISLLESYMSMCEPQTLCHILGFKFKFYQEPNGETPSSLYRVAAVLLQFNLIDLDDLYVHLLPADNCIMDEHKREIAEAKQIVRKLTMVVLSSEKMDEREKEKEKEEEKVEKPPDNQKLGLLEALLKIGDWQHAQNIMDQMPPYYAASHKLIALAICKLIHITIEPLYRRVGVPKGAKGSPVNALQNKRAPKQAESFEDLRRDVFNMFCYLGPHLSHDPILFAKVVRIGKSFMKEFQSDGSKQEDKEKTEVILSCLLSITDQVLLPSLSLMDCNACMSEELWGMFKTFPYQHRYRLYGQWKNETYNSHPLLVKVKAQTIDRAKYIMKRLTKENVKPSGRQIGKLSHSNPTILFDYVCFEILSQIQKYDNLITPVVDSLKYLTSLNYDVLAYCIIEALANPEKERMKHDDTTISSWLQSLASFCGAVFRKYPIDLAGLLQYVANQLKAGKSFDLLILKEVVQKMAGIEITEEMTMEQLEAMTGGEQLKAEGGYFGQIRNTKKSSQRLKDALLDHDLALPLCLLMAQQRNGVIFQEGGEKHLKLVGKLYDQCHDTLVQFGGFLASNLSTEDYIKRVPSIDVLCNEFHTPHDAAFFLSRPMYAHHISSKYDELKKSEKGSKQQHKVHKYITSCEMVMAPVHEAVVSLHVSKVWDDISPQFYATFWSLTMYDLAVPHTSYEREVNKLKVQMKAIDDNQEMIPPQ

SEQ ID NO: 66973 - protein, 189 aa, Homo sapiens
  MOD_RES (1)..(1): Any amino acid
XEQKRRKIDTHPSPSHSSTVKDSLIELKESSAKLYINHTPPPLSKSKEREMDKKDLDKSRERSREREKKDEKDRKERKRDHSNNDREVPPDLTKRRKEENGTMGVSKHKSESPCESPYPNEKDKEKNKSKSSGKEKGSDSFKSEKMDKISSGGKKESRHDKEKIEKKEKRDSSGGKEEKKHHKSSDKHR

SEQ ID NO: 66974 - protein, 351 aa, Homo sapiens
MAVPAAAMGPSALGQSGPGSMAPWCSVSSGPSRYVLGMQELFRGHSKTREFLAHSAKVHSVAWSCDGRRLASGSFDKTASVFLLEKDRLVKENNYRGHGDSVDQLCWHPSNPDLFVTASGDKTIRIWDVRTTKCIATVNTKGENINICWSPDGQTIAVGNKDDVVTFIDAKTHRSKAEEQFKFEVNEISWNNDNNMFFLTNGNGCINILSYPELKPVQSINAHPSNCICIKFDPMGKYFATGSADALVSLWDVDELVCVRCFSRLDWPVRTLSFSHDGKMLASASEDHFIDIAEVETGDKLWEVQCESPTFTVAWHPKRPLLAFACDDKDGKYDSSREAGTVKLFGLPNDS

SEQ ID NO: 66975 - protein, 683 aa, Homo sapiens
MSSESSKKRKPKVIRSDGAPAEGKRNRSDTEQEGKYYSEEAEVDLRDPGRDYELYKYTCQELQRLMAEIQDLKSRGGKDVAIEIEERRIQSCVHFMTLKKLNRLAHIRLKKGRDQTHEAKQKVDAYHLQLQNLLYEVMHLQKEITKCLEFKSKHEEIDLVSLEEFYKEAPPDISKAEVTMGDPHQQTLARLDWELEQRKRLAEKYRECLSNKEKILKEIEVKKEYLSSLQPRLNSIMQASLPVQEYLFMPFDQAHKQYETARHLPPPLYVLFVQATAYGQACDKTLSVAIEGSVDEAKALFKPPEDSQDDESDSDAEEEQTTKRRRPTLGVQLDDKRKEMLKRHPLSVMLDLKCKDDSVLHLTFYYLMNLNIMTVKAKVTTAMELITPISAGDLLSPDSVLSCLYPGDHGKKTPNPANQYQFDKVGILTLSDYVLELGHPYLWVQKLGGLHFPKEQPQQTVIADHSLSASHMETTMKLLKTRVQSRLALHKQFASLEHGIVPVTSDCQYLFPAKVVSRLVKWVTVAHEDYMELHFTKDIVDAGLAGDTNLYYMALIERGTAKLQAAVVLNPGYSSIPPVFQLCLNWKGEKTNSNDDNIRAMEGEVNVCYKELCGPWPSHQLLTNQLQRLCVLLDVYLETESHDDSVEGPKEFPQEKMCLRLFRGPSRMKPFKYNHPQGFFSHR

SEQ ID NO: 66976 - protein, 683 aa, Homo sapiens; identical to SEQ ID NO: 66975

SEQ ID NO: 66977 - protein, 683 aa, Homo sapiens; identical to SEQ ID NO: 66975

SEQ ID NO: 66978 - protein, 93 aa, Homo sapiens
MSSESSKKRKPKVIRSDGAPAEGKRNRSDTEQEGKYYSEEAEVDLRDPGRDYELYKYTCQELQRLMAEIQDLKSRGGKDVAIEIEERRIQSCV

SEQ ID NO: 66979 - protein, 161 aa, Homo sapiens
MSSESSKKRKPKVIRSDGAPAEGKRNRSDTEQEGKYYSEEAEVDLRDPGRDYELYKYTCQELQRLMAEIQDLKSRGGKDVAIEIEERRIQSCVHFMTLKKLNRLAHIRLKKGRDQTHEAKQKVDAYHLQLQNLLYEVMHLQKEITKCLEFKSKHEEIDLVS

SEQ ID NO: 66980 - protein, 223 aa, Homo sapiens
MSSESSKKRKPKVIRSDGAPAEGKRNRSDTEQEGKYYSEEAEVDLRDPGRDYELYKYTCQELQRLMAEIQDLKSRGGKDVAIEIEERRIQSCVHFMTLKKLNRLAHIRLKKGRDQTHEAKQKVDAYHLQLQNLLYEVMHLQKEITKCLEFKSKHEEIDLVSLEEFYKEAPPDISKAEVTMGDPHQQTLARLDWELEQRKRLAEKYRECLSNKEKILKEIEVKK

SEQ ID NO: 66981 - protein, 683 aa, Homo sapiens; identical to SEQ ID NO: 66975

SEQ ID NO: 66982 - protein, 204 aa, Homo sapiens
MGAVTDDEVIRKRLLIDGDGAGDDRRINLLVKSFIKWCNSGSQEEGYSQYQRMLSTLSQCEFSMGKTLLVYDMNLREMENYEKIYKEIECSIAGAHEKIAECKKQILQAKRIRKNRQEYDALAKVIQHHPDRHETLKELEALGKELEHLSHIKESVEDKLELRRKQFHVLLSTIHELQQTLENDEKLSEVEEAQEASMETDPKP

SEQ ID NO: 66983 - protein, 236 aa, Homo sapiens
MSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEA

SEQ ID NO: 66984 - protein, 279 aa, Homo sapiens
MGRAGSPLPRSSWPRMDDCGSRSRCSPTLCSSLRTCYPRGNITMSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEA

SEQ ID NO: 66985 - protein, 236 aa, Homo sapiens; identical to SEQ ID NO: 66983

SEQ ID NO: 66986 - protein, 236 aa, Homo sapiens; identical to SEQ ID NO: 66983

SEQ ID NO: 66987 - protein, 279 aa, Homo sapiens; identical to SEQ ID NO: 66984

SEQ ID NO: 66988 - protein, 236 aa, Homo sapiens; identical to SEQ ID NO: 66983

SEQ ID NO: 66989 - protein, 279 aa, Homo sapiens; identical to SEQ ID NO: 66984

SEQ ID NO: 66990 - protein, 278 aa, Homo sapiens
MIVAAEAVAAPRCALVGDRSGADAPRAKGHSLRTCYPRGNITMSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEA

SEQ ID NO: 66991 - protein, 723 aa, Homo sapiens
MFEEKASSPSGKMGGEEKPIGAGEEKQKEGGKKKNKEGSGDGGRAELNPWPEYIYTRLEMYNILKAEHDSILAEKAEKDSKPIKVTLPDGKQVDAESWKTTPYQIACGISQGLADNTVIAKVNNVVWDLDRPLEEDCTLELLKFEDEEAQAVYWHSSAHIMGEAMERVYGGCLCYGPPIENGFYYDMYLEEGGVSSNDFSSLEALCKKIIKEKQAFERLEVKKETLLAMFKYNKFKCRILNEKVNTPTTTVYRCGPLIDLCRGPHVRHTGKIKALKIHKNSSTYWEGKADMETLQRIYGISFPDPKMLKEWEKFQEEAKNRDHRKIGRDQELYFFHELSPGSCFFLPKGAYIYNALIEFIRSEYRKRGFQEVVTPNIFNSRLWMTSGHWQHYSENMFSFEVEKELFALKPMNCPGHCLMFDHRPRSWRELPLRLADFGVLHRNELSGALTGLTRVRRFQQDDAHIFCAMEQIEDEIKGCLDFLRTVYSVFGFSFKLNLSTRPEKFLGDIEVWDQAEKQLENSLNEFGEKWELNSGDGAFYGPKIDIQIKDAIGRYHQCATIQLDFQLPIRFNLTYVSHDGDDKKRPVIVHRAILGSVERMIAILTENYGGKWPFWLSPRQVMVVPVGPTCDEYAQKVRQQFHDAKFMADIDLDPGCTLNKKIRNAQLAQYNFILVVGEKEKISGTVNIRTRDNKVHGERTISETIERLQQLKEFRSKQAEEEF

SEQ ID NO: 66992 - protein, 602 aa, Homo sapiens
MIPFWQKRQKKIASQLKSLCLMVNRLMRNLGKLHHIKLPVELAMERVYGGCLCYGPPIENGFYYDMYLEEGGVSSNDFSSLEALCKKIIKEKQAFERLEVKKETLLAMFKYNKFKCRILNEKVNTPTTTVYRCGPLIDLCRGPHVRHTGKIKALKIHKNSSTYWEGKADMETLQRIYGISFPDPKMLKEWEKFQEEAKNRDHRKIGRDQELYFFHELSPGSCFFLPKGAYIYNALIEFIRSEYRKRGFQEVVTPNIFNSRLWMTSGHWQHYSENMFSFEVEKELFALKPMNCPGHCLMFDHRPRSWRELPLRLADFGVLHRNELSGALTGLTRVRRFQQDDAHIFCAMEQIEDEIKGCLDFLRTVYSVFGFSFKLNLSTRPEKFLGDIEVWDQAEKQLENSLNEFGEKWELNSGDGAFYGPKIDIQIKDAIGRYHQCATIQLDFQLPIRFNLTYVSHDGDDKKRPVIVHRAILGSVERMIAILTENYGGKWPFWLSPRQVMVVPVGPTCDEYAQKVRQQFHDAKFMADIDLDPGCTLNKKIRNAQLAQYNFILVVGEKEKISGTVNIRTRDNKVHGERTISETIERLQQLKEFRSKQAEEEF

SEQ ID NO: 66993 - protein, 756 aa, Homo sapiens
MFEEKASSPSGKMGGEEKPIGAGEEKQKEGGKKKNKEGSGDGGRAELNPWPEYIYTRLEMYNILKAEHDSILAEKAEKDSKPIKVTLPDGKQVDAESWKTTPYQIACGISHTASCKNLSSLASLLASVAIPSSGMPWPPLFFLQGLADNTVIAKVNNVVWDLDRPLEEDCTLELLKFEDEEAQAVYWHSSAHIMGEAMERVYGGCLCYGPPIENGFYYDMYLEEGGVSSNDFSSLEALCKKIIKEKQAFERLEVKKETLLAMFKYNKFKCRILNEKVNTPTTTVYRCGPLIDLCRGPHVRHTGKIKALKIHKNSSTYWEGKADMETLQRIYGISFPDPKMLKEWEKFQEEAKNRDHRKIGRDQELYFFHELSPGSCFFLPKGAYIYNALIEFIRSEYRKRGFQEVVTPNIFNSRLWMTSGHWQHYSENMFSFEVEKELFALKPMNCPGHCLMFDHRPRSWRELPLRLADFGVLHRNELSGALTGLTRVRRFQQDDAHIFCAMEQIEDEIKGCLDFLRTVYSVFGFSFKLNLSTRPEKFLGDIEVWDQAEKQLENSLNEFGEKWELNSGDGAFYGPKIDIQIKDAIGRYHQCATIQLDFQLPIRFNLTYVSHDGDDKKRPVIVHRAILGSVERMIAILTENYGGKWPFWLSPRQVMVVPVGPTCDEYAQKVRQQFHDAKFMADIDLDPGCTLNKKIRNAQLAQYNFILVVGEKEKISGTVNIRTRDNKVHGERTISETIERLQQLKEFRSKQAEEEF

SEQ ID NO: 66994 - protein, 723 aa, Homo sapiens; identical to SEQ ID NO: 66991

SEQ ID NO: 66995 - protein, 129 aa, Homo sapiens
MFEEKASSPSGKMGGEEKPIGAGEEKQKEGGKKKNKEGSGDGGRAELNPWPEYIYTRLEMYNILKAEHDSILAEKAEKDSKPIKVTLPDGKQVDAESWKTTPYQIACGISQGLADNTVIAKVNNVVWDL

SEQ ID NO: 66996 - protein, 619 aa, Homo sapiens
MEVELSQGLADNTVIAKVNNVVWDLDRPLEEDCTLELLKFEDEEAQAVYWHSSAHIMGEAMERVYGGCLCYGPPIENGFYYDMYLEEGGVSSNDFSSLEALCKKIIKEKQAFERLEVKKETLLAMFKYNKFKCRILNEKVNTPTTTVYRCGPLIDLCRGPHVRHTGKIKALKIHKNSSTYWEGKADMETLQRIYGISFPDPKMLKEWEKFQEEAKNRDHRKIGRDQELYFFHELSPGSCFFLPKGAYIYNALIEFIRSEYRKRGFQEVVTPNIFNSRLWMTSGHWQHYSENMFSFEVEKELFALKPMNCPGHCLMFDHRPRSWRELPLRLADFGVLHRNELSGALTGLTRVRRFQQDDAHIFCAMEQIEDEIKGCLDFLRTVYSVFGFSFKLNLSTRPEKFLGDIEVWDQAEKQLENSLNEFGEKWELNSGDGAFYGPKIDIQIKDAIGRYHQCATIQLDFQLPIRFNLTYVSHDGDDKKRPVIVHRAILGSVERMIAILTENYGGKWPFWLSPRQVMVVPVGPTCDEYAQKVRQQFHDAKFMADIDLDPGCTLNKKIRNAQLAQYNFILVVGEKEKISGTVNIRTRDNKVHGERTISETIERLQQLKEFRSKQAEEEF

SEQ ID NO: 66997 - protein, 443 aa, Homo sapiens
MEHNPLPTSPADQFNTGRYCSGPSTEYGFYHDFFLGKERCGTLVDLCQGPHLRHTGQIGGLKLLSAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGQAGALERPVLIHRAVLGSVERLLGVLAESCGGKWPLWLSPFQVVVIPVGSEQEEYAKEAQQSLRAAGLVSDLDADSGLTLSRRIRRAQLAHYNFQFVVGQKEQSKRTVNIRTRDNRRLGEWDLPEAVQRLVELQNTRVPNAEEIF

SEQ ID NO: 66998 - protein, 443 aa, Homo sapiens [sequence omitted]

SEQ ID NO: 66999 - protein, 178 aa, Homo sapiens [sequence omitted]

SEQ ID NO: 67000 - protein, 588 aa, Homo sapiens
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKAVFWHSSTHVLGAAAEQFLGAVLCRGPSTEYGFYHDFFLGKERTIRGSELPVLERICQELTAAARPFRRLEASRDQLRQLFKAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGQAGALERPVLIHRAVLGSVERLLGVLAESCGGKWPLWLSPFQVVVIPVGSEQEEYAKEAQQSLRAAGLVSDLDADSGLTLSRRIRRAQLAHYNFQFVVGQKEQSKRTVNIRTRDNRRLGEWDLPEAVQRLVELQNTRVPNAEEIF

SEQ ID NO: 67001 - protein, 718 aa, Homo sapiens
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKAVFWHSSTHVLGAAAEQFLGAVLCRGPSTEYGFYHDFFLGKERTIRGSELPVLERICQELTAAARPFRRLEASRDQLRQLFKDNPFKLHLIEEKVTGPTATVYGCGTLVDLCQGPHLRHTGQIGGLKLLSNSSSLWRSSGAPETLQRVSGISFPTTELLRVWEAWREEAELRDHRRIGKEQELFFFHELSPGSCFFLPRGTRVYNALVAFIRAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGQAGALERPVLIHRAVLGSVERLLGVLAESCGGKWPLWLSPFQVVVIPVGSEQEEYAKEAQQSLRAAGLVSDLDADSGLTLSRRIRRAQLAHYNFQFVVGQKEQSKRTVNIRTRDNRRLGEWDLPEAVQRLVELQNTRVPNAEEIF

SEQ ID NO: 67002 - protein, 169 aa, Homo sapiens
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKADNPGLRAACFGADLPGTYSCCSTLPEARGFTGSASPVVQG

SEQ ID NO: 67003 - protein, 1657 aa, Homo sapiens
MGLQARRWASGSRGAAGPRRGVLQLLPLPLPLPLLLLLLLRPGAGRAAAQGEAEAPTLYLWKTGPWGRCMGDECGPGGIQTRAVWCAHVEGWTTLHTNCKQAERPNNQQNCFKVCDWHKELYDWRLGPWNQCQPVISKSLEKPLECIKGEEGIQVREIACIQKDKDIPAEDIICEYFEPKPLLEQACLIPCQQDCIVSEFSAWSECSKTCGSGLQHRTRHVVAPPQFGGSGCPNLTEFQVCQSSPCEAEELRYSLHVGPWSTCSMPHSRQVRQARRRGKNKEREKDRSKGVKDPEARELIKKKRNRNRQNRQENKYWDIQIGYQTREVMCINKTGKAADLSFCQQEKLPMTFQSCVITKECQVSEWSEWSPCSKTCHDMVSPAGTRVRTRTIRQFPIGSEKECPEFEEKEPCLSQGDGVVPCATYGWRTTEWTECRVDPLLSQQDKRRGNQTALCGGGIQTREVYCVQANENLLSQLSTHKNKEASKPMDLKLCTGPIPNTTQLCHIPCPTECEVSPWSAWGPCTYENCNDQQGKKGFKLRKRRITNEPTGGSGVTGNCPHLLEAIPCEEPACYDWKAVRLGNCEPDNGKECGPGTQVQEVVCINSDGEEVDRQLCRDAIFPIPVACDAPCPKDCVLSTWSTWSSCSHTCSGKTTEGKQIRARSILAYAGEEGGIRCPNSSALQEVRSCNEHPCTVYHWQTGPWGQCIEDTSVSSFNTTTTWNGEASCSVGMQTRKVICVRVNVGQVGPKKCPESLRPETVRPCLLPCKKDCIVTPYSDWTSCPSSCKEGDSSIRKQSRHRVIIQLPANGGRDCTDPLYEEKACEAPQACQSYRWKTHKWRRCQLVPWSVQQDSPGAQEGCGPGRQARAITCRKQDGGQAGIHECLQYAGPVPALTQACQIPCQDDCQLTSWSKFSSCNGDCGAVRTRKRTLVGKSKKKEKCKNSHLYPLIETQYCPCDKYNAQPVGNWSDCILPEGKVEVLLGMKVQGDIKECGQGYRYQAMACYDQNGRLVETSRCNSHGYIEEACIIPCPSDCKLSEWSNWSRCSKSCGSGVKVRSKWLREKPYNGGRPCPKLDHVNQFQVYEVVPCHSDCNQYLWVTEPWSICKVTFVNMRENCGEGVQTRKVRCMQNTADGPSEHVEDYLCDPEEMPLGSRVCKLPCPEDCVISEWGPWTQCVLPCNQSSFRQRSADPIRQPADEGRSCPNAVEKEPCNLNKNCYHYDYNVTDWSTCQLSEKAVCGNGIKTRMLDCVRSDGKSVDLKYCEALGLEKNWQMNTSCMVECPVNCQLSDWSPWSECSQTCGLTGKMIRRRTVTQPFQGDGRPCPSLMDQSKPCPVKPCYRWQYGQWSPCQVQEAQCGEGTRTRNISCVVSDGSADDFSKVVDEEFCADIELIIDGNKNMVLEESCSQPCPGDCYLKDWSSWSLCQLTCVNGEDLGFGGIQVRSRPVIIQELENQHLCPEQMLETKSCYDGQCYEYKWMASAWKGSSRTVWCQRSDGINVTGGCLVMSQPDADRSCNPPCSQPHSYCSETKTCHCEEGYTEVMSSNSTLEQCTLIPVVVLPTMEDKRGDVKTSRAVHPTQPSSNPAGRGRTWFLQPFGPDGRLKTWVYGVAAGAFVLLIFIVSMIYLACKKPKKPQRRQNNRLKPLTLAYDGDADM

SEQ ID NO: 67004 - protein, 1657 aa, Homo sapiens
MGLQARRWASGSRGAAGPRRGVLQLLPLPLPLPLLLLLLLRPGAGRAAAQGEAEAPTLYLWKTGPWGRCMGDECGPGGIQTRAVWCAHVEGWTTLHTNCKQAERPNNQQNCFKVCDWHKELYDWRLGPWNQCQPVISKSLEKPLECIKGEEGIQVREIACIQKDKDIPAEDIICEYFEPKPLLEQACLIPCQQDCIVSEFSAWSECSKTCGSGLQHRTRHVVAPPQFGGSGCPNLTEFQVCQSSPCEAEELRYSLHVGPWSTCSMPHSRQVRQARRRGKNKEREKDRSKGVKDPEARELIKKKRNRNRQNRQENKYWDIQIGYQTREVMCINKTGKAADLSFCQQEKLPMTFQSCVITKECQVSEWSEWSPCSKTCHDMVSPAGTRVRTRTIRQFPIGSEKECPEFEEKEPCLSQGDGVVPCATYGWRTTEWTECRVDPLLSQQDKRRGNQTALCGGGIQTREVYCVQANENLLSQLSTHKNKEASKPMDLKLCTGPIPNTTQLCHIPCPTECEVSPWSAWGPCTYENCNDQQGKKGFKLRKRRITNEPTGGSGVTGNCPHLLEAIPCEEPACYDWKAVRLGNCEPDNGKECGPGTQVQEVVCINSDGEEVDRQLCRDAIFPIPVACDAPCPKDCVLSTWSTWSSCSHTCSGKTTEGKQIRARSILAYAGEEGGIRCPNSSALQEVRSCNEHPCTVYHWQTGPWGQCIEDTSVSSFNTTTTWNGEASCSVGMQTRKVICVRVNVGQVGPKKCPESLRPETVRPCLLPCKKDCIVTPYSDWTSCPSSCKEGDSSIRKQSRHRVIIQLPANGGRDCTDPLYEEKACEAPQACQSYRWKTHKWRRCQLVPWSVQQDSPGAQEGCGPGRQARAITCRKQDGGQAGIHECLQYAGPVPALTQACQIPCQDDCQLTSWSKFSSCNGDCGAVRTRKRTLVGKSKKKEKCKNSHLYPLIETQYCPCDKYNAQPVGNWSDCILPEGKVEVLLGMKVQGDIKECGQGYRYQAMACYDQNGRLVETSRCNSHGYIEEACIIPCPSDCKLSEWSNWSRCSKSCGSGVKVRSKWLREKPYNGGRPCPKLDHVNQAQVYEVVPCHSDCNQYLWVTEPWSICKVTFVNMRENCGEGVQTRKVRCMQNTADGPSEHVEDYLCDPEEMPLGSRVCKLPCPEDCVISEWGPWTQCVLPCNQSSFRQRSADPIRQPADEGRSCPNAVEKEPCNLNKNCYHYDYNVTDWSTCQLSEKAVCGNGIKTRMLDCVRSDGKSVDLKYCEALGLEKNWQMNTSCMVECPVNCQLSDWSPWSECSQTCGLTGKMIRRRTVTQPFQGDGRPCPSLMDQSKPCPVKPCYRWQYGQWSPCQVQEAQCGEGTRTRNISCVVSDGSADDFSKVVDEEFCADIELIIDGNKNMVLEESCSQPCPGDCYLKDWSSWSLCQLTCVNGEDLGFGGIQVRSRPVIIQELENQHLCPEQMLETKSCYDGQCYEYKWMASAWKGSSRTVWCQRSDGINVTGGCLVMSQPDADRSCNPPCSQPHSYCSETKTCHCEEGYTEVMSSNSTLEQCTLIPVVVLPTMEDKRGDVKTSRAVHPTQPSSNPAGRGRTWFLQPFGPDGRLKTWVYGVAAGAFVLLIFIVSMIYLACKKPKKPQRRQNNRLKPLTLAYDGDADM

SEQ ID NO: 67005 - protein, 669 aa, Homo sapiens
MSALLSLCFVLPLAAPGHGTQGWEPCTDLRPLDILAEVVPSDGATSGIRIVQVHGARGLQLSVAAPRTMSFPASRIFSQCDLFPEEFSIVVTLRVPNLPPKRNEYLLTVVAEESDLLLLGLRLSPAQLHFLFLREDTAGAWQTRVSFRSPALVDGRWHTLVLAVSAGVFSLTTDCGLPVDIMADVPFPATLSVKGARFFVGSRRRAKGLFMGLVRQLVLLPGSDATPRLCPSRNAPLAVLSIPRVLQALTGKPEDNEVLKYPYETNIRVTLGPQPPCTEVEDAQFWFDASRKGLYLCVGNEWVSVLAAKERLDYVEEHQNLSTNSETLGIEVFRIPQVGLFVATANRKATSAVYKWTEEKFVSYQNIPTHQAQAWRHFTIGKKIFLAVANFEPDEKGQEFSVIYKWSHRKLKFTPYQSIATHSARDWEAFEVDGEHFLAVANHREGDNHNIDSVIYKWNPATRLFEANQTIATSGAYDWEFFSVGPYSFLVVANTFNGTSTKVHSHLYIRLLGSFQLFQSFPTFGAADWEVFQIGERIFLAVANSHSYDVEMQVQNDSYVINSVIYELNVTAQAFVKFQDILTCSALDWEFFSVGEDYFLVVANSFDGRTFSVNSIIYRWQGYEGFVAVHSLPTVGCRDWEAFSTTAGAYLIYSSAKEPLSRVLRLRTR

SEQ ID NO: 67006 - protein, 599 aa, Homo sapiens
MSALLSLCFVLPLAAPGHGTQGWEPCTDLRPLDILAEVVPSDGATSGIRIVQVHGARGLQLSVAAPRTMSFPASRIFSQCDLFPEEFSIVVTLRVPNLPPKRNEYLLTVVAEESDLLLLGLRLSPAQLHFLFLREDTAGAWQTRVSFRSPALVDGRWHTLVLAVSAGVFSLTTDCGLPVDIMADVPFPATLSVKGARFFVGSRRRAKGLFMGLVRQLVLLPGSDATPRLCPSRNAPLAVLSIPRVLQALTGKPEDNEVLKYPYETNIRVTLGPQPPCTEVEDAQFWFDASRKGLYLCVGNEWVSVLAEAKERLDYVEEHQNLSTNSETLGIEVFRIPQVGLFVATANRKATSAVYKWTEEKFVSYQNIPTHQAQAWRHFTIGKKIFLAVANFEPDEKGQEFSVIYKWSHRKLKFTPYQSIATHSARDWEAFEVDGEHFLAVANHREGDNHNIDSVIYKWNPATRLFEANQTIATSGAYDWEFFSVGPYSFLVVANTFNGTSTKVHSHLYIRLLGSFQLFQSFPTFGAADWEVFQIGERIFLAVANSHSYDVEMQVQNDSYVINSVIYELNVTAQAFVKFQDILTCSGGRRGLHARRAEG

SEQ ID NO: 67007 - protein, 522 aa, Homo sapiens
MSALLSLCFVLPLAAPGHGTQGWEPCTDLRPLDILAEVVPSDGATSGIRIVQVHGARGLQLSVAAPRTMSFPASRIFSQCDLFPEEFSIVVTLRVPNLPPKRNEYLLTVVAEESDLLLLGLRLSPAQPPCTEVEDAQFWFDASRKGLYLCVGNEWVSVLAAKERLDYVEEHQNLSTNSETLGIEVFRIPQVGLFVATANRKATSAVYKWTEEKFVSYQNIPTHQAQAWRHFTIGKKIFLAVANFEPDEKGQEFSVIYKWSHRKLKFTPYQSIATHSARDWEAFEVDGEHFLAVANHREGDNHNIDSVIYKWNPATRLFEANQTIATSGAYDWEFFSVGPYSFLVVANTFNGTSTKVHSHLYIRLLGSFQLFQSFPTFGAADWEVFQIGERIFLAVANSHSYDVEMQVQNDSYVINSVIYELNVTAQAFVKFQDILTCSALDWEFFSVGEDYFLVVANSFDGRTFSVNSIIYRWQGYEGFVAVHSLPTVGCRDWEAFSTTAGAYLIYSSAKEPLSRVLRLRTR

SEQ ID NO: 67008 - protein, 534 aa, Homo sapiens
MMEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNEMVPLISQACELLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 67009 - protein, 533 aa, Homo sapiens [sequence omitted]

SEQ ID NO: 67010 - protein, 459 aa, Homo sapiens
MEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNEMVPLISQACELLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERYRCS

SEQ ID NO: 67011 - protein, 460 aa, Homo sapiens
MMEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNEMVPLISQACELLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERYRCS

SEQ ID NO: 67012 - protein, 580 aa, Homo sapiens
MMEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNELGLLIMQERIKGHMGGQQAPQRIPPTRLSKPSGIYVNLHYATLPFCMVPLISQACELLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 67013 - protein, 534 aa, Homo sapiens; identical to SEQ ID NO: 67008

SEQ ID NO: 67014 - protein, 150 aa, Homo sapiens
MEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNE

SEQ ID NO: 67015 - protein, 533 aa, Homo sapiens [sequence omitted]

SEQ ID NO: 67016 - protein, 152 aa, Homo sapiens
MMEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMPQSIMPNSRHHVASRGMWPGGRRLACYLHPFRMAEGIAEV

SEQ ID NO: 67017 - protein, 466 aa, Homo sapiens
MELRKLYGPLCGYYLGRRMFIVISEPDMIKQVLVENFSNFTNRMASGLEFKSVADSVLFLRDKRWEEVRGALMSAFSPEKLNEMVPLISQACELLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 67018 - protein, 343 aa, Homo sapiens
MWPNGSSLGPCFRPTNITLEERRLIASPWFAASFCVVGLASNLLALSVLAGARQGGSHTRSSFLTFLCGLVLTDFLGLLVTGTIVVSQHAALFEWHAVDPGCRLCRFMGVVMIFFGLSPLLLGAAMASERYLGITRPFSRPAVASQRRAWATVGLVWAAALALGLLPLLGVGRYTVQYPGSWCFLTLGAESGDVAFGLLFSMLGGLSVGLSFLLNTVSVATLCHVYHGQEAAQQRPRDSEVEMMAQLLGIMVVASVCWLPLLVFIAQTVLRNPPAMSPAGQLSRTTEKELLIYLRVATWNQILDPWVYILFRRAVLRRLQPRLSTRPRSLSLQPQLTQRSGLQ

SEQ ID NO: 67019 - protein, 407 aa, Homo sapiens
MWPNGSSLGPCFRPTNITLEERRLIASPWFAASFCVVGLASNLLALSVLAGARQGGSHTRSSFLTFLCGLVLTDFLGLLVTGTIVVSQHAALFEWHAVDPGCRLCRFMGVVMIFFGLSPLLLGAAMASERYLGITRPFSRPAVASQRRAWATVGLVWAAALALGLLPLLGVGRYTVQYPGSWCFLTLGAESGDVAFGLLFSMLGGLSVGLSFLLNTVSVATLCHVYHGQEAAQQRPRDSEVEMMAQLLGIMVVASVCWLPLLVFIAQTVLRNPPAMSPAGQLSRTTEKELLIYLRVATWNQILDPWVYILFRRAVLRRLQPRLSTRPRRSLTLWPSLEYSGTISAHCNLRLPGSSDSRASASRAAGITGVSHCARPCMLFDPEFDLLAGVQLLPFEPPTGKALSRKD

SEQ ID NO: 67020 - protein, 473 aa, Homo sapiens
MREVRARLAATQVEYISGKVFFTTCSDLNMLKKLKSAERLFLLIKKQFPLIISSVSKGKIFNEMQRLINEDPGSWLNAISIWKNLLELDAKKEKLSQRDDNQLKRKVGENEIIAKKLKIEQMQKIEENRDCQLEKQIKEETLEQRDFTTKSEKFQEEEFQNDIEKAIDTHNQNDLTFRVSCRCSGTIGKAFTAQEVGKVIGIAIMKHFGWKADLRNPQLEIFIHLNDIYSVVGIPVFRVSLASRAYIKTAGLRSTIAWAMASLADIKAGAFVLDPMCGLGTILLEAAKEWPDVYYVGADVSDSQLLGTWDNLKAAGLEDKIELLKISVIELPLPSESVDIIISDIPFGKKFKLGKDIKSILQEMERVLHVGGTIVLLLSEDHHRRLTDCKESNIPFNSKDSHTDEPGIKKCLNPEEKTGAFKTASTSFEASNHKFLDRMSPFGSLVPVECYKVSLGKTDAFICKYKKSHSSGL

SEQ ID NO: 67021 - protein, 290 aa, Homo sapiens [sequence omitted]

SEQ ID NO: 67022 - protein, 503 aa, Homo sapiens
MSEARGEPGSGPEAGARFFCTAGRGLEPFVMREVRARLAATQVEYISGKVFFTTCSDLNMLKKLKSAERLFLLIKKQFPLIISSVSKGKIFNEMQRLINEDPGSWLNAISIWKNLLELDAKKEKLSQRDDNQLKRKVGENEIIAKKLKIEQMQKIEENRDCQLEKQIKEETLEQRDFTTKSEKFQEEEFQNDIEKAIDTHNQNDLTFRVSCRCSGTIGKAFTAQEVGKVIGIAIMKHFGWKADLRNPQLEIFIHLNDIYSVVGIPVFRVSLASRAYIKTAGLRSTIAWAMASLADIKAGAFVLDPMCGLGTILLEAAKEWPDVYYVGADVSDSQLLGTWDNLKAAGLEDKIELLKISVIELPLPSESVDIIISDIPFGKKFKLGKDIKSILQEMERVLHVGGTIVLLLSEDHHRRLTDCKESNIPFNSKDSHTDEPGIKKCLNPEEKTGAFKTASTSFEASNHKFLDRMSPFGSLVPVECYKVSLGKTDAFICKYKKSHSSGL

SEQ ID NO: 67023 - protein, 161 aa, Homo sapiens
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 67024 - protein, 161 aa, Homo sapiens; identical to SEQ ID NO: 67023

SEQ ID NO: 67025 - protein, 159 aa, Homo sapiens
MFPFALLYVLSVSFRKIFILQLVGLVLTYDFTNCDFEKIKAAYLSTISKDLITYMSGTKSTEFNNTVSCSNRPHCLTEIQSLTFNPTAGCASLAKEMFAMKTKAALAIWCPGYSETQINATQAMKKRRKRKVTTNKCLEQVSQLQGLWRRFNRPLLKQQ

SEQ ID NO: 67026 - protein, 63 aa, Homo sapiens
MFAMKTKAALAIWCPGYSETQINATQAMKKRRKRKVTTNKCLEQVSQLQGLWRRFNRPLLKQQ

SEQ ID NO: 67027 - protein, 234 aa, Homo sapiens
MSCINLPTVLPGSPSKTRGQIQVILGPMFSGKSTELMRRVRRFQIAQYKCLVIKYAKDTRYSSSFCTHDRNTMEALPACLLRDVAQEALGVAVIGIDEGQFFPDIVEFCEAMANAGKTVIVAALDGTFQRKPFGAILNLVPLAESVVKLTAVCMECFREAAYTKRLGTEKEVEVIGGADKYHSVCRLCYFKKASGQPAGPDNKENCPVPGKPGEAVAARKLFAPQQILQCSPAN

SEQ ID NO: 67028 - protein, 234 aa, Homo sapiens; identical to SEQ ID NO: 67027

SEQ ID NO: 67029 - protein, 307 aa, Homo sapiens
MRPGLFKGQAPGSRRRPTAGLAVVRADSHKKEPRASGSARPAMLLWPLRGWAARALRCFGPGSRGSPASGPGPRRVQRRAWPPDKEQEKEKKSVICVEGNIASGKTTCLEFFSNATDVEVLTEPVSKWRNVRGHNPLGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 67030 - protein, 247 aa, Homo sapiens
MLLWPLRGWAARALRCFGPGSRGSPASGPGPRRVQRRAWPPDKEQEKEKKSVICVEGNIASGKTTCLEFFSNATDVEGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 67031 - protein, 265 aa, Homo sapiens
MLLWPLRGWAARALRCFGPGSRGSPASGPGPRRVQRRAWPPDKEQEKEKKSVICVEGNIASGKTTCLEFFSNATDVEVLTEPVSKWRNVRGHNPLGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 67032 - protein, 168 aa, Homo sapiens
MYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 67033 - protein, 234 aa, Homo sapiens
MGAFCQRPSSDKEQEKEKKSVICVEGNIASGKTTCLEFFSNATDVEVLTEPVSKWRNVRGHNPLGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 67034 - protein, 168 aa, Homo sapiens; identical to SEQ ID NO: 67032

SEQ ID NO: 67035 - protein, 216 aa, Homo sapiens
MTSICVEGNIASGKTTCLEFFSNATDVEVLTEPVSKWRNVRGHNPLGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 67036 - protein, 240 aa, Homo sapiens
MLLWPLRGWAARALRCFGPGSRGSPASGPGPRRVQRRAWPPDKEQEKEKKSVVLTEPVSKWRNVRGHNPLGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 67037 - protein, 279 aa, Homo sapiens
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 67038 - protein, 230 aa, Homo sapiens
MPVAGSELPRRPLPPAAQERDAEPRPPHGELQYLGQIQHILRCGVRKDDRTGTGTLSVFGMQARYSLRDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 67039 - protein, 313 aa, Homo sapiens
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 67040 - protein, 225 aa, Homo sapiens
MSRPRKRLAGTSGSDKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKIVKEAYPDHTQFEKNNPHYDPSSKEDNPKWSMVDVQFVRMMKRFIPLAELKSYHQAHKATGGPLKNMVLFTRQRLSIQPLTQEEFDFVLSLEEKEPS

SEQ ID NO: 67041 - protein, 166 aa, Homo sapiens
MSRPRKRLAGTSGSDKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKIVKEAYPDHTQFEKNNPHYDPSSKEDNPKWSMKSLILF

SEQ ID NO: 67042 - protein, 225 aa, Homo sapiens; identical to SEQ ID NO: 67040

SEQ ID NO: 67043 - protein, 225 aa, Homo sapiens; identical to SEQ ID NO: 67040

SEQ ID NO: 67044 - protein, 641 aa, Homo sapiens
MALSLEEFVHSLDLRTLPRVLEIQAGIYLEGSIYEMFGNECCFSTGEVIKITGLKVKKIIAEICEQIEGCESLQPFELPMNFPGLFKIVADKTPYLTMEEITRTIHIGPSRLGHPCFYHQKDIKLENLIIKQGEQIMLNSVEEIDGEIMVSCAVARNHQTHSFNLPLSQEGEFYECEDERIYTLKEIVEWKIPKNRTRTVNLTDFSNKWDSTNPFPKDFYGTLILKPVYEIQGVMKFRKDIIRILPSLDVEVKDITDSYDANWFLQLLSTEDLFEMTSKEFPIVTEVIEAPEGNHLPQSILQPGKTIVIHKKYQASRILASEIRSNFPKRHFLIPTSYKGKFKRRPREFPTAYDLEIAKSEKEPLHVVATKAFHSPHDKLSSVSVGDQFLVHQSETTEVLCEGIKKVVNVLACEKILKKSYEAALLPLYMEGGFVEVIHDKKQYPISELCKQFRLPFNVKVSVRDLSIEEDVLAATPGLQLEEDITDSYLLISDFANPTECWEIPVGRLNMTVQLVSNFSRDAEPFLVRTLVEEITEEQYYMMRRYESSASHPPPRPPKHPSVEETKLTLLTLAEERTVDLPKSPKRHHVDITKKLHPNQAGLDSKVLIGSQNDLVDEEKERSNRGATAIAETFKNEKHQK

SEQ ID NO: 67045 - protein, 562 aa, Homo sapiens
MNFPGLFKIVADKTPYLTMEEITRTIHIGPSRLGHPCFYHQKDIKLENLIIKQGEQIMLNSVEEIDGEIMVSCAVARNHQTHSFNLPLSQEGEFYECEDERIYTLKEIVEWKIPKNRTRTVNLTDFSNKWDSTNPFPKDFYGTLILKPVYEIQGVMKFRKDIIRILPSLDVEVKDITDSYDANWFLQLLSTEDLFEMTSKEFPIVTEVIEAPEGNHLPQSILQPGKTIVIHKKYQASRILASEIRSNFPKRHFLIPTSYKGKFKRRPREFPTAYDLEIAKSEKEPLHVVATKAFHSPHDKLSSVSVGDQFLVHQSETTEVLCEGIKKVVNVLACEKILKKSYEAALLPLYMEGGFVEVIHDKKQYPISELCKQFRLPFNVKVSVRDLSIEEDVLAATPGLQLEEDITDSYLLISDFANPTECWEIPVGRLNMTVQLVSNFSRDAEPFLVRTLVEEITEEQYYMMRRYESSASHPPPRPPKHPSVEETKLTLLTLAEERTVDLPKSPKRHHVDITKKLHPNQAGLDSKVLIGSQNDLVDEEKERSNRGATAIAETFKNEKHQK

SEQ ID NO: 67046 - protein, 123 aa, Homo sapiens
MNFPVRKDIIRILPSLDVEVKDITDSYDANWFLQLLSTEDLFEMTSKEFPIVTEVIEAPEGNHLPQSILQPGKTIVIHKKYQASRILASEIRSNFPKRHFLIPTSYKGKFKRRPREFPTAYDL

SEQ ID NO: 67047 - protein, 606 aa, Homo sapiens
MFGNECCFSTGEVIKITGLKVKKIIAEICEQIEGCESLQPFELPMNFPGLFKIVADKTPYLTMEEITRTIHIGPSRLGHPCFYHQKDIKLENLIIKQGEQIMLNSVEEIDGEIMVSCAVARNHQTHSFNLPLSQEGEFYECEDERIYTLKEIVEWKIPKNRTRTVNLTDFSNKWDSTNPFPKDFYGTLILKPVYEIQGVMKFRKDIIRILPSLDVEVKDITDSYDANWFLQLLSTEDLFEMTSKEFPIVTEVIEAPEGNHLPQSILQPGKTIVIHKKYQASRILASEIRSNFPKRHFLIPTSYKGKFKRRPREFPTAYDLEIAKSEKEPLHVVATKAFHSPHDKLSSVSVGDQFLVHQSETTEVLCEGIKKVVNVLACEKILKKSYEAALLPLYMEGGFVEVIHDKKQYPISELCKQFRLPFNVKVSVRDLSIEEDVLAATPGLQLEEDITDSYLLISDFANPTECWEIPVGRLNMTVQLVSNFSRDAEPFLVRTLVEEITEEQYYMMRRYESSASHPPPRPPKHPSVEETKLTLLTLAEERTVDLPKSPKRHHVDITKKLHPNQAGLDSKVLIGSQNDLVDEEKERSNRGATAIAETFKNEKHQK

SEQ ID NO: 67048 - protein, 680 aa, Homo sapiens
MALSLEEFVHSLDLRTLPRVLEIQAGIYLEGSIYEMFGNECCFSTGEVIKITGLKVKKIIAEICEQIEGCESLQPFELPMNFPGLFKIVADKTPYLTMEEITRTIHIGPSRLGHPCFYHQKDIKLENLIIKQGEQIMLNSVEEIDGEIMVSCAVARNHQTHSFNLPLSQEGEFYECEDERIYTLKEIVEWKIPKNRTRTVNLTDFSNKWDSTNPFPKDFYGTLILKPVYEIQGVMKFRKDIIRILPSLDVEVKDITDSYDANWFLQLLSTEDLFEMTSKEFPIVTEVIEAPEGNHLPQSILQPGKTIVIHKKYQASRILASEIRSNFPKRHFLIPTSYKGKFKRRPREFPTAYDLEIAKSEKEPLHVVATKAFHSPHDKLSSVSVGDQFLVHQSETTEVLCEGIKKVVNVLACEKILKKSYEAALLPLYMEGGFVEVIHDKKQYPISELCKQFRLPFNVKVSVRDLSIEEDVLAATPGLQLEEDITDSYLLISDFANPTECWEIPVGRLNMTVQLVSNFSRDAEPFLVRTLVEEITEEQYYMMRRYESSASHPPPRPPKHPSVEETKLTLLTLAEERTVDLPKSPKAGVQWRDLGSLQPLPPGFKQFSASASHVAGITGTPHHVQRHHVDITKKLHPNQAGLDSKVLIGSQNDLVDEEKERSNRGATAIAETFKNEKHQK

SEQ ID NO: 67049 - protein, 526 aa, Homo sapiens
MDVRFYPPPAQPAAAPDAPCLGPSPCLDPYYCNKFDGENMYMSMTEPSQDYVPASQSYPGPSLESEDFNIPPITPPSLPDHSLVHLNEVESGYHSLCHPMNHNGLLPFHPQNMDLPEITVSNMLGQDGTLLSNSISVMPDIRNPEGTQYSSHPQMAAMRPRGQPADIRQQPGMMPHGQLTTINQSQLSAQLGLNMGGSNVPHNSPSPPGSKSATPSPSSSVHEDEGDDTSKINGGEKRPASDMGKKPKTPKKKKKKDPNEPQKPVSAYALFFRDTQAAIKGQNPNATFGEVSKIVASMWDGLGEEQKQVYKKKTEAAKKEYLKQLAAYRASLVSKSYSEPVDVKTSQPPQLINSKPSVFHGPSQAHSALYLSSHYHQQPGMNPHLTAMHPSLPRNIAPKPNNQMPVTVSIANMAVSPPPPLQISPPLHQHLNMQQHQPLTMQQPLGNQLPMQVQSALHSPTMQQGFTLQPDYQTIINPTSTAAQVVTQAMEYVRSGCRNPPPQPVDWNNDYCSSGGMQRDKALYLT

SEQ ID NO: 67050 - protein, 276 aa, Homo sapiens
MGKKPKTPKKKKKKDPNEPQKPVSAYALFFRDTQAAIKGQNPNATFGEVSKIVASMWDGLGEEQKQVYKKKTEAAKKEYLKQLAAYRASLVSKSYSEPVDVKTSQPPQLINSKPSVFHGPSQAHYHQQPGMNPHLTAMHPSLPRNIAPKPNNQMPVTVSIANMAVSPPPPLQISPPLHQHLNMQQHQPLTMQQPLGNQLPMQVQSALHSPTMQQGFTLQPDYQTIINPTSTAAQVVTQAMEYVRSGCRNPPPQPVDWNNDYCSSGGMQRDKALYLT

SEQ ID NO: 67051 - protein, 248 aa, Homo sapiens
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQVSLVLLPPCTGINNLLTTLIHVLAFNG

SEQ ID NO: 67052 - protein, 694 aa, Homo sapiens
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEGKKKEHKKVKSTRDIVPFSELGTTPSGGGFFQGISFPEISTRPPLGSTELQAAKKVHTSKGDLPREPLVATNLPGRGQLQKLASERNLFISCKSSHDRCLEKSSSSSSQPEHSAMLVSTAASPSLIKETTTGYYKDIVENICGREKSGIQPLCPERSHISDQSPLSSKRKALEESESSQLISPPLAQAIRDYVNSLLVQGGVGSLPGTSNSMPPLDVENIQKRIDQSKFQETEFLSPPRKVPRLSEKSVEERDSGSFVAFQNIPGSELMSSFAKTVVSHSLTTLGLEVAKQSQHDKIDASELSFPFHESILKVIEEEWQQVDRQLPSLACKYPVSSREATQILSVPKVDDEILGFISEATPLGGIQAASTESCNQQLDLALCRAYEAAASALQIATHTAFVAKAMQADISQAAQILSSDPSRTHQALGILSKTYDAASYICEAAFDEVKMAAHTMGNATVGRRYLWLKDCKINLASKNKLASTPFKGGTLFGGEVCKVIKKRGNKH

SEQ ID NO: 67053 - protein, 414 aa, Homo sapiens
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQVETSEHFRIDGPVISESTPIAETIMASSNESLVVNRVTGNFKHASPILPITEFSDIPRRAPKKPLTRAEVGEKTEERRVERDILKEMFPYEASTPTGISASCRRPIKGAAGRPLELSDFRMEESFSSKYVPKYVPLADVKSEKTKKGRSIPVWIKILLFVVVAVFLFLVYQAMETNQVNPFSNFLHVDPRKSN

SEQ ID NO: 67054 - protein, 345 aa, Homo sapiens
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQVGEKTEERRVERDILKEMFPYEASTPTGISASCRRPIKGAAGRPLELSDFRMEESFSSKYVPKYVPLADVKSEKTKKGRSIPVWIKILLFVVVAVFLFLVYQAMETNQVNPFSNFLHVDPRKSN

SEQ ID NO: 67055 - protein, 454 aa, Homo sapiens
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQSYSQAGITETEWTSGSSKGGPLQALTRESTRGSRRTPRKRVETSEHFRIDGPVISESTPIAETIMASSNESLVVNRVTGNFKHASPILPITEFSDIPRRAPKKPLTRAEVGEKTEERRVERDILKEMFPYEASTPTGISASCRRPIKGAAGRPLELSDFRMEESFSSKYVPKYVPLADVKSEKTKKGRSIPVWIKILLFVVVAVFLFLVYQAMETNQVNPFSNFLHVDPRKSN

SEQ ID NO: 67056 - protein, 44 aa, Homo sapiens
MSDKPDMAEIEKFDKSKLKKTETQEKNPLPSKETIEQEKQAGES

SEQ ID NO: 67057 - protein, 44 aa, Homo sapiens; identical to SEQ ID NO: 67056

SEQ ID NO: 67058 - protein, 44 aa, Homo sapiens; identical to SEQ ID NO: 67056

SEQ ID NO: 67059 - protein, 44 aa, Homo sapiens; identical to SEQ ID NO: 67056

SEQ ID NO: 67060 - protein, 44 aa, Homo sapiens
MSDKPGMAEIEKFDKSKLKKTETQEKNPLSSKETIEQERQAGES

SEQ ID NO: 67061 - protein, 2768 aa, Homo sapiens
MALVLEIFTLLASICWVSANIFEYQVDAQPLRPCELQRETAFLKQADYVPQCAEDGSFQTVQCQNDGRSCWCVGANGSEVLGSRQPGRPVACLSFCQLQKQQILLSGYINSTDTSYLPQCQDSGDYAPVQCDVQQVQCWCVDAEGMEVYGTRQLGRPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 67062 - protein, 2711 aa, Homo sapiens
MALVLEIFTLLASICWVSANIFEYQVDAQPLRPCELQRETAFLKQADYVPQCAEDGSFQTVQCQNDGRSCWCVGANGSEVLGSRQPGRPVACLSFCQLQKQQILLSGYINSTDTSYLPQCQDSGDYAPVQCDVQQVQCWCVDAEGMEVYGTRQLGRPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHLMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 67063 - protein, 887 aa, Homo sapiens
MALVLEIFTLLASICWVSANIFEYQVDAQPLRPCELQRETAFLKQADYVPQCAEDGSFQTVQCQNDGRSCWCVGANGSEVLGSRQPGRPVACLSFCQLQKQQILLSGYINSTDTSYLPQCQDSGDYAPVQCDVQQVQCWCVDAEGMEVYGTRQLGRPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 67064 - protein, 1138 aa, Homo sapiens
MMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 67065 - protein, 1574 aa, Homo sapiens
IPRKPISKRPVRPSLPRSPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 67066 - protein, 451 aa, Homo sapiens
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKLLMKGPQVRQLEQQLGEAGSLQGPVLQHQSPKSPQQRLLELLHRSGILHARAVCGEDDSSEADSPSSSEEEPEVCEDLAGNAASP

SEQ ID NO: 67067 - protein, 1979 aa, Homo sapiens
MSSWLGGLGSGLGQSLGQVGGSLASLTGQISNFTKDMLMEGTEEVEAELPDSRTKEIEAIHAILRSENERLKKLCTDLEEKHEASEIQIKQQSTSYRNQLQQKEVEISHLKARQIALQDQLLKLQSAAQSVPSGAGVPATTASSSFAYGISHHPSAFHDDDMDFGDIISSQQEINRLSNEVSRLESEVGHWRHIAQTSKAQGTDNSDQSEICKLQNIIKELKQNRSQEIDDHQHEMSVLQNAHQQKLTEISRRHREELSDYEERIEELENLLQQGGSGVIETDLSKIYEMQKTIQVLQIEKVESTKKMEQLEDKIKDINKKLSSAENDRDILRREQEQLNVEKRQIMEECENLKLECSKLQPSAVKQSDTMTEKERILAQSASVEEVFRLQQALSDAENEIMRLSSLNQDNSLAEDNLKLKMRIEVLEKEKSLLSQEKEELQMSLLKLNNEYEVIKSTATRDISLDSELHDLRLNLEAKEQELNQSISEKETLIAEIEELDRQNQEATKHMILIKDQLSKQQNEGDSIISKLKQDLNDEKKRVHQLEDDKMDITKELDVQKEKLIQSEVALNDLHLTKQKLEDKVENLVDQLNKSQESNVSIQKENLELKEHIRQNEEELSRIRNELMQSLNQDSNSNFKDTLLKEREAEVRNLKQNLSELEQLNENLKKVAFDVKMENEKLVLACEDVRHQLEECLAGNNQLSLEKNTIVETLKMEKGEIEAELCWAKKRLLEEANKYEKTIEELSNARNLNTSALQLEHEHLIKLNQKKDMEIAELKKNIEQMDTDHKETKDVLSSSLEEQKQLTQLINKKEIFIEKLKERSSKLQEELDKYSQALRKNEILRQTIEEKDRSLGSMKEENNHLQEELERLREEQSRTAPVADPKTLDSVTELASEVSQLNTIKEHLEEEIKHHQKIIEDQNQSKMQLLQSLQEQKKEMDEFRYQHEQMNATHTQLFLEKDEEIKSLQKTIEQIKTQLHEERQDIQTDNSDIFQETKVQSLNIENGSEKHDLSKAETERLVKGIKERELEIKLLNEKNISLTKQIDQLSKDEVGKLTQIIQQKDLEIQALHARISSTSHTQDVVYLQQQLQAYAMEREKVFAVLNEKTRENSHLKTEYHKMMDIVAAKEAALIKLQDENKKLSTRFESSGQDMFRETIQNLSRIIREKDIEIDALSQKCQTLLAVLQTSSTGNEAGGVNSNQFEELLQERDKLKQQVKKMEEWKQQVMTTVQNMQHESAQLQEELHQLQAQVLVDSDNNSKLQVDYTGLIQSYEQNETKLKNFGQELAQVQHSIGQLCNTKDLLLGKLDIISPQLSSASLLTPQSAECLRASKSEVLSESSELLQQELEELRKSLQEKDATIRTLQENNHRLSDSIAATSELERKEHEQTDSEIKQLKEKQDVLQKLLKEKDLLIKAKSDQLLSSNENFTNKVNENELLRQAVTNLKERILILEMDIGKLKGENEKIVETYRGKETEYQALQETNMKFSMMLREKEFECHSMKEKALAFEQLLKEKEQGKTGELNQLLNAVKSMQEKTVVFQQERDQVMLALKQKQMENTALQNEVQRLRDKEFRSNQELERLRNHLLESEDSYTREALAAEDREAKLRKKVTVLEEKLVSSSNAMENASHQASVQVESLQEQLNVVSKQRDETALQLSVSQEQVKQYALSLANLQMVLEHFQQEEKAMYSAELEKQKQLIAEWKKNAENLEGKVISLQECLDEANAALDSASRLTEQLDVKEEQIEELKRQNELRQEMLDDVQKKLMSLANSSEGKVDKVLMRNLFIGHFHTPKNQRHEVLRLMGSILGVRREEMEQLFHDDQGGVTRWMTGWLGGGSKSVPNTPLRPNQQSVVNSSFSELFVKFLETESHPSIPPPKLSVHDMKPLDSPGRRKRDTNAPESFKDTAESRSGRRTDVNPFLAPRSAAVPLINPAGLGPGGPGHLLLKPISDVLPTFTPLPALPDNSAGVVLKDLLKQ

SEQ ID NO: 67068 - protein, 1715 aa, Homo sapiens
MSVLQNAHQQKLTEISRRHREELSDYEERIEELENLLQQGGSGVIETDLSKIYEMQKTIQVLQIEKVESTKKMEQLEDKIKDINKKLSSAENDRDILRREQEQLNVEKRQIMEECENLKLECSKLQPSAVKQSDTMTEKERILAQSASVEEVFRLQQALSDAENEIMRLSSLNQEELQMSLLKLNNEYEVIKSTATRDISLDSELHDLRLNLEAKEQELNQSISEKETLIAEIEELDRQNQEATKHMILIKDQLSKQQNEGDSIISKLKQDLNDEKKRVHQLEDDKMDITKELDVQKEKLIQSEVALNDLHLTKQKLEDKVENLVDQLNKSQESNVSIQKENLELKEHIRQNEEELSRIRNELMQSLNQDSNSNFKDTLLKEREAEVRNLKQNLSELEQLNENLKKVAFDVKMENEKLVLACEDVRHQLEECLAGNNQLSLEKNTIVETLKMEKGEIEAELCWAKKRLLEEANKYEKTIEELSNARNLNTSALQLEHEHLIKLNQKKDMEIAELKKNIEQMDTDHKETKDVLSSSLEEQKQLTQLINKKEIFIEKLKERSSKLQEELDKYSQALRKNEILRQTIEEKDRSLGSMKEENNHLQEELERLREEQSRTAPVADPKTLDSVTELASEVSQLNTIKEHLEEEIKHHQKIIEDQNQSKMQLLQSLQEQKKEMDEFRYQHEQMNATHTQLFLEKDEEIKSLQKTIEQIKTQLHEERQDIQTDNSDIFQETKVQSLNIENGSEKHDLSKAETERLVKGIKERELEIKLLNEKNISLTKQIDQLSKDEVGKLTQIIQQKDLEIQALHARISSTSHTQDVVYLQQQLQAYAMEREKVFAVLNEKTRENSHLKTEYHKMMDIVAAKEAALIKLQDENKKLSTRFESSGQDMFRETIQNLSRIIREKDIEIDALSQKCQTLLAVLQTSSTGNEAGGVNSNQFEELLQERDKLKQQVKKMEEWKQQVMTTVQNMQHESAQLQEELHQLQAQVLVDSDNNSKLQVDYTGLIQSYEQNETKLKNFGQELAQVQHSIGQLCNTKDLLLGKLDIISPQLSSASLLTPQSAECLRASKSEVLSESSELLQQELEELRKSLQEKDATIRTLQENNHRLSDSIAATSELERKEHEQTDSEIKQLKEKQDVLQKLLKEKDLLIKAKSDQLLSSNENFTNKVNENELLRQAVTNLKERILILEMDIGKLKGENEKIVETYRGKETEYQALQETNMKFSMMLREKEFECHSMKEKALAFEQLLKEKEQGKTGELNQLLNAVKSMQEKTVVFQQERDQVMLALKQKQMENTALQNEVQRLRDKEFRSNQELERLRNHLLESEDSYTREALAAEDREAKLRKKVTVLEEKLVSSSNAMENASHQASVQVESLQEQLNVVSKQRDETALQLSVSQEQVKQYALSLANLQMVLEHFQQEEKAMYSAELEKQKQLIAEWKKNAENLEGKVISLQECLDEANAALDSASRLTEQLDVKEEQIEELKRQNELRQEMLDDVQKKLMSLANSSEGKVDKVLMRNLFIGHFHTPKNQRHEVLRLMGSILGVRREEMEQLFHDDQGGVTRWMTGWLGGGSKSVPNTPLRPNQQSVVNSSFSELFVKFLETESHPSIPPPKLSVHDMKPLDSPGRRKRDTNAPESFKDTAESRSGRRTDVNPFLAPRSAAVPLINPAGLGPGGPGHLLLKPISDVLPTFTPLPALPDNSAGVVLKDLLKQ

SEQ ID NO: 67069 - protein, 1992 aa, Homo sapiens
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQSKTGGSSKFDWAARFSPKVSLPKTKLSLPGSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 67070 - protein, 99 aa, Homo sapiens
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTE

SEQ ID NO: 67071 - protein, 2040 aa, Homo sapiens
MSNRPNNNPGGSLRRSQRNTAGAQPQDDSIGGRSHLGQAKHKGYSPPESRKSNSKAPKVQSNTTSELSRGHLSKRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQSKTGGSSKFDWAARFSPKVSLPKTKLSLPGSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAASSSVAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 67072 - protein, 1722 aa, Homo sapiens
MSNRPNNNPGGSLRRSQRNTAGAQPQDDSIGGSRRGSGLGKRGAAEARRQEKMADPESNQEAVNSSAARTDEAPQGAAASSSVAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEAAHQVGEDEISLSTLGRVYTIDFNSMQQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 67073 - protein, 149 aa, Homo sapiens
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKR

SEQ ID NO: 67074 - protein, 154 aa, Homo sapiens
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTES

SEQ ID NO: 67075 - protein, 346 aa, Homo sapiens [sequence omitted]

SEQ ID NO: 67076 - protein, 581 aa, Homo sapiens
MAVAGAVSGEPLVHWCTQQLRKTFGLDVSEEIIQYVLSIESAEEIREYVTDLLQGNEGKKGQFIEELITKWQKNDQELISDPLQQCFKKDEILDGQKSGDHLKRGRKKGRNRQEVPAFTEPDTTAEVKTPFDLAKAQENSNSVKKKTKFVNLYTREGQDRLAVLLPGRHPCDCLGQKHKLINNCLICGRIVCEQEGSGPCLFCGTLVCTHEEQDILQRDSNKSQKLLKKLMSGVENSGKVDISTKDLLPHQELRIKSGLEKAIKHKDKLLEFDRTSIRRTQVIDDESDYFASDSNQWLSKLERETLQKREEELRELRHASRLSKKVTIDFAGRKILEEENSLAEYHSRLDETIQAIANGTLNQPLTKLDRSSEEPLGVLVNPNMYQSPPQWVDHTGAASQKKAFRSSGFGLEFNSFQHQLRIQDQEFQEGFDGGWCLSVHQPWASLLVRGIKRVEGRSWYTPHRGRLWIAATAKKPSPQEVSELQATYRLLRGKDVEFPNDYPSGCLLGCVDLIDCLSQKQFKEQFPDISQESDSPFVFICKNPQEMVVKFPIKGNPKIWKLDSKIHQGAKKGLMKQNKAV

SEQ ID NO: 67077 - protein, 476 aa, Homo sapiens
MSGPTWLPPKQPEPARAPQGRAIPRGTPGPPPAHGAALQPHPRVNFCPLPSEQCYQAPGGPEDRGPAWVGSHGVLQHTQGLPADRGGLRPGSLDAEIDLLSSTLAELNGGRGHASRRPDRQAYEPPPPPAYRTGSLKPNPASPLPASPYGGPTPASYTTASTPAGPAFPVQVKVAQPVRGCGPPRRGASQASGPLPGPHFPLPGRGEVWGPGYRSQREPGPGAKEEAAGVSGPAGRGRGGEHGPQVPLSQPPEDELDRLTKKLVHDMNHPPSGEYFGQCGGCGEDVVGDGAGVVALDRVFHVGCFVCSTCRAQLRGQHFYAVERRAYCEGCYVATLEKCATCSQPILDRILRAMGKAYHPGCFTCVVCHRGLDGIPFTVDATSQIHCIEDFHRKFAPRCSVCGGAIMPEPGQEETVRIVALDRSFHIGCYKCEECGLLLSSEGECQGCYPLDGHILCKACSAWRIQELSATVTTDC

SEQ ID NO: 67078 - protein, 490 aa, Homo sapiens
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKLLMKEREVQSSILYKGAAAEGRPGGSLGVHPEGQQLLGMHVVQGPQVRQLEQQLGEAGSLQGPVLQHQSPKSPQQRLLELLHRSGILHARAVCGEDDSSEADSPSSSEEEPEVCEDLAGNAASP

SEQ ID NO: 67079 - protein, 490 aa, Homo sapiens; identical to SEQ ID NO: 67078

SEQ ID NO: 67080 - protein, 410 aa, Homo sapiens
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKLLMKVTDLRMIGACHASRFLHMKVECPTELFPPLFLEVFEDQEV

SEQ ID NO: 67081 - protein, 410 aa, Homo sapiens; identical to SEQ ID NO: 67080

SEQ ID NO: 67082 - protein, 461 aa, Homo sapiens
MTPNSMTENGLTAWDKPKHCPDREHDWKLVGMSEACLHRKSHSERRSTLKNEQSSPHLIQTTWTSSIFHLDHDDVNDQSVSSAQTFQTEEKKCKGYIPSYLDKDELCVVCGDKATGYHYRCITCEGCKGFFRRTIQKNLHPSYSCKYEGKCVIDKVTRNQCQECRFKKCIYVGMATDLVLDDSKRLAKRKLIEENREKRRREELQKSIGHKPEPTDEEWELIKTVTEAHVATNAQGSHWKQKRKFLPEDIGQAPIVNAPEGGKVDLEAFSHFTKIITPAITRVVDFAKKLPMFCELPCEDQIILLKGCCMEIMSLRAAVRYDPESETLTLNGEMAVTRGQLKNGGLGVVSDAIFDLGMSLSSFNLDDTEVALLQAVLLMSSDRPGLACVERIEKYQDSFLLAFEHYINYRKHHVTHFWPKLLMKVTDLRMIGACHASRFLHMKVECPTELFPPLFLEVFED

SEQ ID NO: 67083 - protein, 461 aa, Homo sapiens; identical to SEQ ID NO: 67082

SEQ ID NO: 67084 - protein, 461 aa, Homo sapiens; identical to SEQ ID NO: 67082

SEQ ID NO: 67085 - protein, 28 aa, Homo sapiens
MTPNSMTEMALQPGTNRSTVQTENTTGS

SEQ ID NO: 67086 - protein, 121 aa, Homo sapiens
MTPNSMTENGLTAWDKPKHCPDREHDWKLVGMSEACLHRKSHSERRSTLKNEQSSPHLIQTTWTSSIFHLDHDDVNDQSVSSAQTFQTEEKKCKGYIPSYLDKDELCVVCGDKATGYHYRC

SEQ ID NO: 67087 - protein, 146 aa, Homo sapiens
MQVLTKRYPKNCLLTVMDRYAAEVHNMEQVVMIPSLLRDVQLSGPGGQAQAEAPDLYTYFTMLKAICVDVDHGLLPREEWQAKVAGSEENGTAETEEVEDESASGELDLEAQFHLHFSSLHHILMHLTEKAQEVTRKYQEMTGQVW

SEQ ID NO: 67088 - protein, 933 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 67089 - protein, 929 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWRVLGWKAGILTGCREPSEGKVAGHCRTASCSQNHRTTLFQTQANPKSAGRLFSQHG

SEQ ID NO: 67090 - protein, 933 aa, Homo sapiens; identical to SEQ ID NO: 67088

SEQ ID NO: 67091 - protein, 889 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 67092 - protein, 760 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 67093 - protein, 760 aa, Homo sapiens; identical to SEQ ID NO: 67092

SEQ ID NO: 67094 - protein, 876 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 67095 - protein, 172 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTA

SEQ ID NO: 67096 - protein, 153 aa, Homo sapiens
MNGLTSFLDASTVYGSSPALERQLRNWTSAEGLLRVHARLRDSGRAYLPFVPPRAPAACAPEPGIPGETRGPCFLAGDPRQRGPLPDGTAHAVAARAQPPGRGAQGPQCALERGRRVPGGAQGRGRSAPDHHPEGLHPQDPGTRGLPAVRGSL

SEQ ID NO: 67097 - protein, 174 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRKMKYKPDHSETAN

SEQ ID NO: 67098 - protein, 764 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHEMRQGLHNMEDVYELIENSHLTPKKQGQISEEYMQTVL

SEQ ID NO: 67099 - protein, 253 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLLPLGRKSLSFETQKAPRSSMPS

SEQ ID NO: 67100 - protein, 411 aa, Homo sapiens
MRPADLLQLVLLLDLPRDLGGMGCSSPPCECHQEEDFRVTCKDIQRIPSLPPSTQTLKLIETHLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHEMRQGLHNMEDVYELIENSHLTPKKQGQISEEYMQTVL

SEQ ID NO: 67101 - protein, 764 aa, Homo sapiens; identical to SEQ ID NO: 67098

SEQ ID NO: 67102 - protein, 274 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLVENVAVSGKGFCKSLFSWLYRLPLGRKSLSFETQKAPRSSMPS

SEQ ID NO: 67103 - protein, 303 aa, Homo sapiens
MSDAGGGKKPPVDPQAGPGPGPGRAAGERGLSGSFPLVLKKLMENPPREARLDKEKGKEKLEEDEAAAASTMAVSASLMPPIWDKTIPYDGESFHLEYMDLDEFLLENGIPASPTHLAHNLLLPVAELEGKESASSSTASPPSSSTAIFQPSETVSSTESSLEKERETPSPIDPNCVEVDVNFNPDPADLVLSSVPGGELFNPRKHKFAEEDLKPQPMIKKAKKVFVPDEQKDEKYWTRRKKNNVAAKRSRDARRLKENQITIRAAFLEKENTALRTEVAELRKEVGKCKTIVSKYETKYGPL

SEQ ID NO: 67104 - protein, 184 aa, Homo sapiens
  MOD_RES (1)..(1): Any amino acid
XFIFLPRPGTSLGRIRKADKEKGKEKLEEDEAAAASTMAVSASLMPPIWDKTIPYDGESFHLEYMDLDEFLLENGIPASPTHLAHNLLLPVAELEGKESASSSTASPPSSSTAIFQPSETVSSTESSLEKERETPSPIDPNCVEVDVNFNPDPADLVLSSVPGGELFNPRKHKFAEEDLKPQPM

SEQ ID NO: 67105 - protein, 273 aa, Homo sapiens
MDMPEVLKSLLEHSLPWPEKRTDKEKGKEKLEEDEAAAASTMAVSASLMPPIWDKTIPYDGESFHLEYMDLDEFLLENGIPASPTHLAHNLLLPVAELEGKESASSSTASPPSSSTAIFQPSETVSSTESSLEKERETPSPIDPNCVEVDVNFNPDPADLVLSSVPGGELFNPRKHKFAEEDLKPQPMIKKAKKVFVPDEQKDEKYWTRRKKNNVAAKRSRDARRLKENQITIRAAFLEKENTALRTEVAELRKEVGKCKTIVSKYETKYGPL

SEQ ID NO: 67106 - protein, 273 aa, Homo sapiens; identical to SEQ ID NO: 67105

SEQ ID NO: 67107 - protein, 242 aa, Homo sapiens
MPGPWLLLALALTLNLTGVPGGRAQPEAAQQEAVTAAEHPGLDDFLRQVERLLFLRENIQRLQGDQGEHSASQIFQSDWLSKRQHPGKREEEEEEGVEEEEEEEGGAVGPHKRQHPGRREDEASWSVDVTQHKRQHPGRRSPWLAYAVPKRQHPGRRLADPKAQRSWEEEEEEEEREEDLMPEKRQHPGKRALGGPCGPQGAYGQAGLLLGLLDDLSRSQGAEEKRQHPGRRAAWVREPLEE

SEQ ID NO: 67108 - protein, 1024 aa, Homo sapiens
MGEDDAALRAGSRGLSDPWADSVGVRPRTTERHIAVHKRLVLAFAVSLVALLAVTMLAVLLSLRFDECGASATPGADGGPSGFPERGGNGSLPGSARRNHHAGGDSWQPEAGGVASPGTTSAQPPSEEEREPWEPWTQLRLSGHLKPLHYNLMLTAFMENFTFSGEVNVEIACRNATRYVVLHASRVAVEKVQLAEDRAFGAVPVAGFFLYPQTQVLVVVLNRTLDAQRNYNLKIIYNALIENELLGFFRSSYVLHGERRFLGVTQFSPTHARKAFPCFDEPIYKATFKISIKHQATYLSLSNMPVETSVFEEDGWVTDHFSQTPLMSTYYLAWAICNFTYRETTTKSGVVVRLYARPDAIRRGSGDYALHITKRLIEFYEDYFKVPYSLPKLDLLAVPKHPYAAMENWGLSIFVEQRILLDPSVSSISYLLDVTMVIVHEICHQWFGDLVTPVWWEDVWLKEGFAHYFEFVGTDYLYPGWNMEKQRFLTDVLHEVMLLDGLASSHPVSQEVLQATDIDRVFDWIAYKKGAALIRMLANFMGHSVFQRGLQDYLTIHKYGNAARNDLWNTLSEALKRNGKYVNIQEVMDQWTLQMGYPVITILGNTTAENRIIITQQHFIYDISAKTKALKLQNNSYLWQIPLTIVVGNRSHVSSEAIIWVSNKSEHHRITYLDKGSWLLGNINQTGYFRVNYDLRNWRLLIDQLIRNHEVLSVSNRAGLIDDAFSLARAGYLPQNIPLEIIRYLSEEKDFLPWHAASRALYPLDKLLDRMENYNIFNEYILKQVATTYIKLGWPKNNFNGSLVQASYQHEELRREVIMLACSFGNKHCHQQASTLISDWISSNRNRIPLNVRDIVYCTGVSLLDEDVWEFIWMKFHSTTAVSEKKILLEALTCSDDRNLLNRLLNLSLNSEVVLDQDAIDVIIHVARNPHGRDLAWKFFRDKWKILNTRYGEALFMNSKLISGVTEFLNTEGELKELKNFMKNYDGVAAASFSRAVETVEANVRWKMLYQDELFQWLGKALRH

SEQ ID NO: 67109 - protein, 398 aa, Homo sapiens
MENETVSELNQTQLQPRAVVALEYQVVTILLVLIICGLGIVGNIMVVLVVMRTKHMRTPTNCYLVSLAVADLMVLVAAGLPNITDSIYGSWVYGYVGCLCITYLQYLGINASSCSITAFTIERYIAICHPIKAQFLCTFSRAKKIIIFVWAFTSLYCMLWFFLLDLNISTYKDAIVISCGYKISRNYYSPIYLMDFGVFYVVPMILATVLYGFIARILFLNPIPSDPKENSKTWKNDSTHQNTNLNVNTSNRCFNSTVSSRKQVTKMLAVVVILFALLWMPYRTLVVVNSFLSSPFQENWFLLFCRICIYLNSAINPVIYNLMSQKFRAAFRKLCNCKQKPTEKPANYSVALNYSVIKESDHFSTELDDITVTDTYLSATKVSFDDTCLASEVSFSQS

SEQ ID NO: 67110 - protein, 398 aa, Homo sapiens; identical to SEQ ID NO: 67109

SEQ ID NO: 67111 - protein, 375 aa, Homo sapiens
MEDEMPKTLYVGNLSRDVTEALILQLFSQIGPCKNCKMIMDTAGNDPYCFVEFHEHRHAAAALAAMNGRKIMGKEVKVNWATTPSSQKKDTSNHFHVFVGDLSPEITTEDIKAAFAPFGRISDARVVKDMATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 67112 - protein, 386 aa, Homo sapiens
MEDEMPKTLYVGNLSRDVTEALILQLFSQIGPCKNCKMIMDTAGNDPYCFVEFHEHRHAAAALAAMNGRKIMGKEVKVNWATTPSSQKKDTSSSTVVSTQRSQDHFHVFVGDLSPEITTEDIKAAFAPFGRISDARVVKDMATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 67113 - protein, 463 aa, Homo sapiens
PLVSRETPLSCSHNRLNDLGGSEGQGAGPGGAAATAAAMEDEMPKTLYVGNLSRDVTEALILQLFSQIGPCKNCKMIMDTAGNDPYCFVEFHEHRHAAAALAAMNGRKIMGKEVKVNWATTPSSQKKDTSSSTVVSTQRSQDHFHVFVGDLSPEITTEDIKAAFAPFGRISDARVVKDMATGKSKGYGFVSFFNKWDAENAIQQMGGQWLGGRQIRTNWATRKPPAPKSTYECRCIGEEKEMWNFGEKYARFCSRRLIAEIDEKQIKTTIQKSNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 67114 - protein, 85 aa, Homo sapiens
MITEHTSNDPYCFVEFYEHRDAAAALAAMNGRKILGKEVKVNWATTPSSQKKDTSNHFHVFVGDLSPEITTEDIKSAFAPFGKIS

SEQ ID NO: 67115 - protein, 252 aa, Homo sapiens
MDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 67116 - protein, 392 aa, Homo sapiens
MMEDDGQPRTLYVGNLSRDVTEVLILQLFSQIGPCKSCKMITEQPDSRRVNSSVGFSVLQHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 67117 - protein, 132 aa, Homo sapiens
MITEHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTN

SEQ ID NO: 67118 - protein, 375 aa, Homo sapiens
MMEDDGQPRTLYVGNLSRDVTEVLILQLFSQIGPCKSCKMITEHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 67119 - protein, 591 aa, Homo sapiens
MASKCSSERKSRTSLTLNQKLEMIKLSEEGMSKAEIGRRLGLLRQTVSQVVNAKEKFLKEVKSATPMNTRMIRKRNSLIADMEKVLVVWIEDQTSRNIPLSQSLIQNKALTLFNSMKAERGVEAAEEKFEASRGWFMRFKERSHFHNIKAQGEAASADVEAAASYPEALAKIIDEGGYTKQQIFNVDETAFYWKKMPSRTFIAREEKSVPGFKASKDRLTLLLGANAAGDFKLKPMLIYHSENPRALKNYTKSTLPVLYKWNSKARMTAHLFTAWFTEYFKPTVETYCSEKKIPFKILLLIDNAPSHPRALMEIYEEINVIFMPANTTSILQPMDQGVISTFKSYYLRNTFHKALAAMDSDVSDGSGQSKLKTFWKGFTILDAIKNIRDSWEEVKLSTLTGVWKKLIPTLIDDYEGFKTSVEEVSADVVEIAKELELEVEPEDVTELLQSHDKTLTDEELFLMDAQRKWFLEMESTPGEDAVNIVEMTTKDLEYYINLVDKAAAGFERIDSNFERSSTVGKMLSNSIACYREIFHERKSQLMRKASPMSYFRKLPQPPQPSAATTLTSQQPSTSRQDPPPAKRVRLTEGSD

SEQ ID NO: 67120 - protein, 525 aa, Homo sapiens
MLGKRKRVVLTIKDKLDIIKKLEEGISFKKLSVVYGIGESTVRDIKKNKERIINYANSSDPTSGVSKRKSMKSSTYEELDRVMIEWFNQQKTDGIPVSGTICAKQAKFFFDALGMEGDFNASSGWLTRFKQRHGIPKAAGKGTKLKGDETAAREFCGSFQEFVEKENLQPEQIYGADQTGLFWKCLPSRTLTLETDQSTSGCRSSRERIIIMCCANATGLHKLNLCVVGKAKKPRAFKGTDLSNLPVTYYSQKGAWIEQSVFRQWFEKYFVPQVQKHLKSKGLLEKAVLLLDFPPARPNEEMLSSDDGRIIVKYLPPNVTSLIQPMSQGVLATVKRYYRAGLLQKYMDEGNDPKIFWKNLTVLDAIYEVSRAWNMVKSSTITKAWKKLFPGNEENSGMNIDEGAILAANLATVLQNTEECEHVDIENIDQWFDSRSSDSSCQVLTDSESAEDQTKAAEQKPSSKSRKTELNPEKHISHKAALEWTENLLDYLEQQDDMLLSDKLVLRRLRTIIRKKQKIQNNKNH

SEQ ID NO: 67121 - protein, 549 aa, Homo sapiens
MNKRGKYTTLNLEEKMKVLSRIEAGRSLKSVMDEFGISKSTFYDIKKNKKLILDFVLKQDMPLVGAEKRKRTTGAKYGDVDDAVYMWYQQKRSAGVPVRGVELQAAAERFARCFGRTDFKASTGWLFRFRNRHAIGNRKGCGEQVLSSVSENVEPFRQKLSMIIKEEKLCLAQLYSGDETDLFWKSMPENSQASRKDICLPGKKINKERLSAFLCANADGTHKLKSIIIGKSKLPKSVKEDTSTLPVIYKPSKDVWFTRELFSEWFFQNFVPEVRHFQLNVLRFHDEDVRALLLLDSCPAHPSSESLTSEDGRIKCMFFPHNTSTLIQPMNQGVILSCKRLYRWKQLEESLVIFEESDDEQEKGDKGVSKIKIYNIKSAIFNWAKSWEEVKQITIANAWENLLYKKEPEYDFQGLEHGDYREILEKCGELETKLDDDRVWLNGDEEKGCLLKTKGGITKEVVQKGGEAEKQTAEFKLSAVRESLDYLLDFVDATPEFQRFHFTLKEMQQEIVKKQFQSKIHSRIGSFLKPRPHNIKDSFSGPSTSGSNH

SEQ ID NO: 67122 - protein, 549 aa, Homo sapiens; identical to SEQ ID NO: 67121

SEQ ID NO: 67123 - protein, 511 aa, Homo sapiens
MNKRGKYTTLNLEEKMKVLSRIEAGRSLKSVMDEFGISKSTFYDIKKNKKLILDFVLKQDMPLVGAEKRKRTTGAKYGDVDDAVYMWYQQKRSAGVPVRGVELQAAAERFARCFGRTDFKASTGWLFRFRNRHAIGNRKGCGEQVLSSVSENVEPFRQKLSMIIKEEKLCLAQLYSGDETDLFWKSMPENSQASRKDICLPGKKINKERLSAFLCANADGTHKLKSIIIGKSKLPKSVKEDTSTLPVIYKPSKDVWFTRELFSEWFFQNFVPEVRHFQLNVLRFHDEDVRALLLLDSCPAHPSSESLTSEDGRIKCMFFPHNTSTLIQPMNQGVILSCKRLYRWKQLEESLVIFEESDDEQEKGDKGVSKIKIYNIKSAIFNWAKSWEEVKQITIANAWENLLYKKEPEYDFQGLEHGDYREILEKCGELETKLDDDRVWLNGDEEKGCLLKTKGGITKEVVQKGGEAEKQTAEFKLSAVRESLDYLLDFVDATPEFQRFHFTLCEFSDDS

SEQ ID NO: 67124 - protein, 547 aa, Homo sapiens
MTSAAPAKKPYRKAPPEHRELRLEIPGSRLEQEEPLTDAERMKLLQEENEELRRRLASATRRTEALERELEIGQDCLELELGQSREELDKFKDKFRRLQNSYTASQRTNQELEDKLHTLIKKAEMDRKTLDWEIVELTNKLLDAKNTINKLEELNERYRLDCNLAVQLLKCNKSHFRNHKFADLPCELQDMVRKHLHSGQEAASPGPAPSLAPGAVVPTSVIARVLEKPESLLLNSAQSGSAGRPLAEDVFVHVDMSEGVPGDPASPPAPGSPTPQPNGECHSLGTARGSPEEELPLPAFEKLNPYPTPSPPHPLYPGRRVIEFSEDKVRIPRNSPLPNCTYATRQAISLSLVEEGSERARPSPVPSTPASAQASPHHQPSPAPLTLSAPASSASSEEDLLVSWQRAFVDRTPPPAAVAQRTAFGRDALPELQRHFAHSPADRDEVVQAPSARPEESELLLPTEPDSGFPREEEELNLPISPEEERQSLLPINRGTEEGPGTSHTEGRAWPLPSSSRPQRSPKRMGVHHLHRKDSLTQAQEQGNLLN

SEQ ID NO: 67125 - protein, 547 aa, Homo sapiens; identical to SEQ ID NO: 67124

SEQ ID NO: 67126 - protein, 557 aa, Homo sapiens
MTSAAPAKKPYRKAPPEHRELRLEIPGSRLEQEEPLTDAERMKLLQEENEELRRRLASATRRTEALERELEIGQDCLELELGQSREELDKFKDKFRRLQNSYTASQRTNQELEDKLHTLASLSHSWIFAIKKAEMDRKTLDWEIVELTNKLLDAKNTINKLEELNERYRLDCNLAVQLLKCNKSHFRNHKFADLPCELQDMVRKHLHSGQEAASPGPAPSLAPGAVVPTSVIARVLEKPESLLLNSAQSGSAGRPLAEDVFVHVDMSEGVPGDPASPPAPGSPTPQPNGECHSLGTARGSPEEELPLPAFEKLNPYPTPSPPHPLYPGRRVIEFSEDKVRIPRNSPLPNCTYATRQAISLSLVEEGSERARPSPVPSTPASAQASPHHQPSPAPLTLSAPASSASSEEDLLVSWQRAFVDRTPPPAAVAQRTAFGRDALPELQRHFAHSPADRDEVVQAPSARPEESELLLPTEPDSGFPREEEELNLPISPEEERQSLLPINRGTEEGPGTSHTEGRAWPLPSSSRPQRSPKRMGVHHLHRKDSLTQAQEQGNLLN

SEQ ID NO: 67127 - protein, 557 aa, Homo sapiens; identical to SEQ ID NO: 67126

SEQ ID NO: 67128 - protein, 547 aa, Homo sapiens; identical to SEQ ID NO: 67124

SEQ ID NO: 67129 - protein, 547 aa, Homo sapiens; identical to SEQ ID NO: 67124

SEQ ID NO: 67130 - protein, 547 aa, Homo sapiens; identical to SEQ ID NO: 67124

SEQ ID NO: 67131 - protein, 557 aa, Homo sapiens; identical to SEQ ID NO: 67126

SEQ ID NO: 67132 - protein, 193 aa, Homo sapiens
MTSAAPAKKPYRKAPPEHRELRLEIPGSRLEQEEPLTDAERMKLLQEENEELRRRLASATRRTEALERELEIGQDCLELELGQSREELDKFKDKFRRLQNSYTASQRTNQELEDKLHTLASLSHSWIFAIKKAEMDRKTLDWEIVELTNKLLDAKNTINKLEELNERYRLDCNLAVQLLKCNKSHFRNHKFAD

SEQ ID NO: 67133 - protein, 239 aa, Homo sapiens
  MOD_RES (1)..(1): Any amino acid
XLLQEENEELRRRLASATRRTEALERELEIGQDCLELELGQSREELDKFKDKFRRLQNSYTASQRTNQELEDKLHTLIKKAEMDRKTLDWEIVELTNKLLDAKNTINKLEELNERYRLDCNLAVQLLKCNKSHFRNHKFADVSRTHPLPAHIDHSGHCRTPLTPVSAPLSVLLFPLCPPLASMSPLKPVNSATGWCPVYCPGPITSSGGPALLVSVTETEREDPGQEGEGSQSYLPKEY

SEQ ID NO: 67134 - protein, 1748 aa, Homo sapiens
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCDPKTWQNKCLPGDPNYLVGANCVSVLIDHF

SEQ ID NO: 67135 - protein, 1668 aa, Homo sapiens
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCDPKTWQNKCLPGDPNYLVGANCVSVLIDHF

SEQ ID NO: 67136 - protein, 993 aa, Homo sapiens
MPVRGDRGFPPRRELSGWLRAPGMEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEDPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEEVRRGRPRAGTGEPGVFLALSWTAVCSGCCGRHS

SEQ ID NO: 67137 - protein, 1043 aa, Homo sapiens
MPVRGDRGFPPRRELSGWLRAPGMEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEDPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEEIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 67138 - protein, 1190 aa, Homo sapiens
MPVRGDRGFPPRRELSGWLRAPGMEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEDPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEESIRKPSPEPRAQMRRAASSDQLRDNSPPPAFKPEPPKAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 67139 - protein, 101 aa, Homo sapiens
MEELIWEQYTVTLQKDSKRGFGIAVSGGRDNPHFENGETSIVISDVLPGGPADGLLQENDRVVMVNGTPMEDVLHSFAVQQLRKSGKVAAIVSTGFAFSLP

SEQ ID NO: 67140 - protein, 161 aa, Homo sapiens
MEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERA

SEQ ID NO: 67141 - protein, 1020 aa, Homo sapiens
MEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEDPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEEIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 67142 - protein, 1157 aa, Homo sapiens
MKTAQALHRMWIQAVKKLRRWKGRAPGMEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEDPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEEAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 67143 - protein, 1221 aa, Homo sapiens
MKTAQALHRMWIQAVKKLRRWKGRVSPSASSPLVFPNLSSWEGEGSKTILTAPGMEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEDPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEESIRKPSPEPRAQMRRAASSDQLRDNSPPPAFKPEPPKAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 67144 - protein, 928 aa, Homo sapiens
MAVRFQVADMEELTIWEQHTATLSKDPRRGFGIAISGGRDRPGGSMVVSDVVPGGPAEGRLQTGDHIVMVNGVSMENATSAFAIQILKTCTKMANITVKRPRRIHLPATKASPSSPGRQDSDEDDGPQRVEEVDQGRGYDGDSSSGSGRSWDERSRRPRPGRRGRAGSHGRRSPGGGSEANGLALVSGFKRLPRQDVQMKPVKSVLVKRRDSEEFGVKLGSQIFIKHITDSGLAARHRGLQEGDLILQINGVSSQNLSLNDTRRLIEKSEGKLSLLVLRDRGQFLVNIPPAVSDSDSSPLEDISDLASELSQAPPSHIPPPPRHAQRSPEASQTDSPVESPRLRRESSVDSRTISEPDEQRSELPRESSYDIYRVPSSQSMEDRGYSPDTRVVRFLKGKSIGLRLAGGNDVGIFVSGVQAGSPADGQGIQEGDQILQVNDVPFQNLTREEAVQFLLGLPPGEEMELVTQRKQDIFWKMVQSRVGDSFYIRTHFELEPSPPSGLGFTRGDVFHVLDTLHPGPGQSHARGGHWLAVRMGRDLREQERGIIPNQSRAEQLASLEAAQRAVGVGPGSSAGSNARAEFWRLRGLRRGAKKTTQRSREDLSALTRQGRYPPYERVVLREASFKRPVVILGPVADIAMQKLTAEMPDQFEIAETVSRTDSPSKIIKLDTVRVIAEKDKHALLDVTPSAIERLNYVQYYPIVVFFIPESRPALKALRQWLAPASRRSTRRLYAQAQKLRKHSSHLFTATIPLNGTSDTWYQELKAIIREQQTRPIWTAEDQLDGSLEDNLDLPHHGLADSSADLSCDSRVNSDYETDGEGGAYTDGEGYTDGEGGPYTDVDDEPPAPALARSSEPVQADESQSPRDRGRISAHQGAQVDSRHPQGQWRQDSMRTYEREALKKKFMRVHDAESSDEDGYDWGPATDL

SEQ ID NO: 67145 - protein, 952 aa, Homo sapiens
MNLCGLMPIFPAPLDQVADMEELTIWEQHTATLSKDPRRGFGIAISGGRDRPGGSMVVSDVVPGGPAEGRLQTGDHIVMVNGVSMENATSAFAIQILKTCTKMANITVKRPRRIHLPATKASPSSPGRQDSDEDDGPQRVEEVDQGRGYDGDSSSGSGRSWDERSRRPRPGRRGRAGSHGRRSPGGGSEANGLALVSGFKRLPRQDVQMKPVKSVLVKRRDSEEFGVKLGSQIFIKHITDSGLAARHRGLQEGDLILQINGVSSQNLSLNDTRRLIEKSEGKLSLLVLRDRGQFLVNIPPAVSDSDSSPLEEGVTMADEMSSPPADISDLASELSQAPPSHIPPPPRHAQRSPEASQTDSPVESPRLRRESSVDSRTISEPDEQRSELPRESSYDIYRVPSSQSMEDRGYSPDTRVVRFLKGKSIGLRLAGGNDVGIFVSGVQAGSPADGQGIQEGDQILQVNDVPFQNLTREEAVQFLLGLPPGEEMELVTQRKQDIFWKMVQSRVGDSFYIRTHFELEPSPPSGLGFTRGDVFHVLDTLHPGPGQSHARGGHWLAVRMGRDLREQERGIIPNQSRAEQLASLEAAQRAVGVGPGSSAGSNARAEFWRLRGLRRGAKKTTQRSREDLSALTRQGRYPPYERVVLREASFKRPVVILGPVADIAMQKLTAEMPDQFEIAETVSRTDSPSKIIKLDTVRVIAEKDKHALLDVTPSAIERLNYVQYYPIVVFFIPESRPALKALRQWLAPASRRSTRRLYAQAQKLRKHSSHLFTATIPLNGTSDTWYQELKAIIREQQTRPIWTAEDQLDGSLEDNLDLPHHGLADSSADLSCDSRVNSDYETDGEGGAYTDGEGYTDGEGGPYTDVDDEPPAPALARSSEPVQADESQSPRDRGRISAHQGAQVDSRHPQGQWRQDSMRTYEREALKKKFMRVHDAESSDEDGYDWGPATDL

SEQ ID NO: 67146 - protein, 933 aa, Homo sapiens [sequence omitted]

SEQ ID NO: 67147 - protein, 883 aa, Homo sapiens
MVVSDVVPGGPAEGRLQTGDHIVMVNGVSMENATSAFAIQILKTCTKMANITVKRPRRIHLPATKASPSSPGRQDSDEDDGPQRVEEVDQGRGYDGDSSSGSGRSWDERSRRPRPGRRGRAGSHGRRSPGGGSEANGLALVSGFKRLPRQDVQMKPVKSVLVKRRDSEEFGVKLGSQIFIKHITDSGLAARHRGLQEGDLILQINGVSSQNLSLNDTRRLIEKSEGKLSLLVLRDRGQFLVNIPPAVSDSDSSPLEDISDLASELSQAPPSHIPPPPRHAQRSPEASQTDSPVESPRLRRESSVDSRTISEPDEQRSELPRESSYDIYRVPSSQSMEDRGYSPDTRVVRFLKGKSIGLRLAGGNDVGIFVSGVQAGSPADGQGIQEGDQILQVNDVPFQNLTREEAVQFLLGLPPGEEMELVTQRKQDIFWKMVQSRVGDSFYIRTHFELEPSPPSGLGFTRGDVFHVLDTLHPGPGQSHARGGHWLAVRMGRDLREQERGIIPNQSRAEQLASLEAAQRAVGVGPGSSAGSNARAEFWRLRGLRRGAKKTTQRSREDLSALTRQGRYPPYERVVLREASFKRPVVILGPVADIAMQKLTAEMPDQFEIAETVSRTDSPSKIIKLDTVRVIAEKDKHALLDVTPSAIERLNYVQYYPIVVFFIPESRPALKALRQWLAPASRRSTRRLYAQAQKLRKHSSHLFTATIPLNGTSDTWYQELKAIIREQQTRPIWTAEDQLDGSLEDNLDLPHHGLADSSADLSCDSRVNSDYETDGEGGAYTDGEGYTDGEGGPYTDVDDEPPAPALARSSEPVQADESQSPRDRGRISAHQGAQVDSRHPQGQWRQDSMRTYEREALKKKFMRVHDAESSDEDGYDWGPATDL

SEQ ID NO: 67148 - protein, 919 aa, Homo sapiens
MEELTIWEQHTATLSKDPRRGFGIAISGGRDRPGGSMVVSDVVPGGPAEGRLQTGDHIVMVNGVSMENATSAFAIQILKTCTKMANITVKRPRRIHLPATKASPSSPGRQDSDEDDGPQRVEEVDQGRGYDGDSSSGSGRSWDERSRRPRPGRRGRAGSHGRRSPGGGSEANGLALVSGFKRLPRQDVQMKPVKSVLVKRRDSEEFGVKLGSQIFIKHITDSGLAARHRGLQEGDLILQINGVSSQNLSLNDTRRLIEKSEGKLSLLVLRDRGQFLVNIPPAVSDSDSSPLEDISDLASELSQAPPSHIPPPPRHAQRSPEASQTDSPVESPRLRRESSVDSRTISEPDEQRSELPRESSYDIYRVPSSQSMEDRGYSPDTRVVRFLKGKSIGLRLAGGNDVGIFVSGVQAGSPADGQGIQEGDQILQVNDVPFQNLTREEAVQFLLGLPPGEEMELVTQRKQDIFWKMVQSRVGDSFYIRTHFELEPSPPSGLGFTRGDVFHVLDTLHPGPGQSHARGGHWLAVRMGRDLREQERGIIPNQSRAEQLASLEAAQRAVGVGPGSSAGSNARAEFWRLRGLRRGAKKTTQRSREDLSALTRQGRYPPYERVVLREASFKRPVVILGPVADIAMQKLTAEMPDQFEIAETVSRTDSPSKIIKLDTVRVIAEKDKHALLDVTPSAIERLNYVQYYPIVVFFIPESRPALKALRQWLAPASRRSTRRLYAQAQKLRKHSSHLFTATIPLNGTSDTWYQELKAIIREQQTRPIWTAEDQLDGSLEDNLDLPHHGLADSSADLSCDSRVNSDYETDGEGGAYTDGEGYTDGEGGPYTDVDDEPPAPALARSSEPVQADESQSPRDRGRISAHQGAQVDSRHPQGQWRQDSMRTYEREALKKKFMRVHDAESSDEDGYDWGPATDL

SEQ ID NO: 67149 - protein, 1207 aa, Homo sapiens
MDLHMMNCELLATCSALGYLEGDTYHKEPDCLESVKDLIRYLRHEDETRDVRQQLGAAQILQSDLLPILTQHHQDKPLFDAVIRLMVNLTQPALLCFGNLPKEPSFRHHFLQVLTYLQAYKEAFASEKAFGVLSETLYELLQLGWEERQEEDNLLIERILLLVRNILHVPADLDQEKIDDDASAHDQLLWAIHLSGLDDLLLFLASSSAEEQWSLHVLEIVSLMFRDQNPEQLAGVGQGRLAQERSADFAELEVLRQREMAEKKTRALQRGNRHSRFGGSYIVQGLKSIGERDLIFHKGLHNLRNYSSDLGKQPKKVPKRRQAARELSIQRRSALNVRLFLRDFCSEFLENCYNRLMGSVKDHLLREKAQQHDETYYMWALAFFMAFNRAASFRPGLVSETLSVRTFHFIEQNLTNYYEMMLTDRKEAASWARRMHLALKAYQELLATVNEMDISPDEAVRESSRIIKNNIFYVMEYRELFLALFRKFDERCQPRSFLRDLVETTHLFLKMLERFCRSRGNLVVQNKQKKRRKKKKKVLDQAIVSGNVPSSPEEVEAVWPALAEQLQCCAQNSELSMDSVVPFDAASEVPVEEQRAEAMVRIQDCLLAGQAPQALTLLRSAREVWPEGDVFGSQDISPEEEIQLLKQILSAPLPRQQGPEERGAEEEEEEEEEEEEELQVVQVSEKEFNFLDYLKRFACSTVVRAYVLLLRSYQQNSAHTNHCIVKMLHRLAHDLKMEALLFQLSVFCLFNRLLSDPAAGAYKELVTFAKYILGKFFALAAVNQKAFVELLFWKNTAVVREMTEGYGSLDDRSSSRRAPTWSPEEEAHLRELYLANKDVEGQDVVEAILAHLNTVPRTRKQIIHHLVQMGLADSVKDFQRKGTHIVLWTGDQELELQRLFEEFRDSDDVLGHIMKNITAKRSRARIVDKLLALGLVAERRELYKKRQKKLASSILPNGAESLKDFCQEDLEEEENLPEEDSEEEEEGGSEAEQVQGSLVLSNENLGQSLHQEGFSIPLLWLQNCLIRAADDREEDGCSQAVPLVPLTEENEEAMENEQFQQLLRKLGVRPPASGQETFWRIPAKLSPTQLRRAAASLSQPEEEQKLQPELQPKVPGEQGSDEEHCKEHRAQALRALLLAHKKKAGLASPEEEDAVGKEPLKAAPKKRQLLDSDEEQEEDEGRNRAPELGAPGIQKKKRYQIEDDEDD

SEQ ID NO: 67150 - protein, 1208 aa, Homo sapiens
MDLHMMNCELLATCSALGYLEGDTYHKEPDCLESVKDLIRYLRHEDETRDVRQQLGAAQILQSDLLPILTQHHQDKPLFDAVIRLMVNLTQPALLCFGNLPKEPSFRHHFLQVLTYLQAYKEAFASEKAFGVLSETLYELLQLGWEERQEEDNLLIERILLLVRNILHVPADLDQEKKIDDDASAHDQLLWAIHLSGLDDLLLFLASSSAEEQWSLHVLEIVSLMFRDQNPEQLAGVGQGRLAQERSADFAELEVLRQREMAEKKTRALQRGNRHSRFGGSYIVQGLKSIGERDLIFHKGLHNLRNYSSDLGKQPKKVPKRRQAARELSIQRRSALNVRLFLRDFCSEFLENCYNRLMGSVKDHLLREKAQQHDETYYMWALAFFMAFNRAASFRPGLVSETLSVRTFHFIEQNLTNYYEMMLTDRKEAASWARRMHLALKAYQELLATVNEMDISPDEAVRESSRIIKNNIFYVMEYRELFLALFRKFDERCQPRSFLRDLVETTHLFLKMLERFCRSRGNLVVQNKQKKRRKKKKKVLDQAIVSGNVPSSPEEVEAVWPALAEQLQCCAQNSELSMDSVVPFDAASEVPVEEQRAEAMVRIQDCLLAGQAPQALTLLRSAREVWPEGDVFGSQDISPEEEIQLLKQILSAPLPRQQGPEERGAEEEEEEEEEEEEELQVVQVSEKEFNFLDYLKRFACSTVVRAYVLLLRSYQQNSAHTNHCIVKMLHRLAHDLKMEALLFQLSVFCLFNRLLSDPAAGAYKELVTFAKYILGKFFALAAVNQKAFVELLFWKNTAVVREMTEGYGSLDDRSSSRRAPTWSPEEEAHLRELYLANKDVEGQDVVEAILAHLNTVPRTRKQIIHHLVQMGLADSVKDFQRKGTHIVLWTGDQELELQRLFEEFRDSDDVLGHIMKNITAKRSRARIVDKLLALGLVAERRELYKKRQKKLASSILPNGAESLKDFCQEDLEEEENLPEEDSEEEEEGGSEAEQVQGSLVLSNENLGQSLHQEGFSIPLLWLQNCLIRAADDREEDGCSQAVPLVPLTEENEEAMENEQFQQLLRKLGVRPPASGQETFWRIPAKLSPTQLRRAAASLSQPEEEQKLQPELQPKVPGEQGSDEEHCKEHRAQALRALLLAHKKKAGLASPEEEDAVGKEPLKAAPKKRQLLDSDEEQEEDEGRNRAPELGAPGIQKKKRYQIEDDEDD

SEQ ID NO: 67151 - protein, 301 aa, Homo sapiens
MLEPQENGVIDLPDYEHVEDETFPPFPPPASPERQDGEGTEPDEESGNGAPVRVPPKRTVKRNIPKLDAQRLISERGLPALRHVFDKAKFKGKGHEAEDLKMLIRHMEHWAHRLFPKLQFEDFIDRVEYLGSKKEVQTCLKRIRLDLPILHEDFVSNNDEVAENNEHDVTSTELDPFLTNLSESEMFASELSRSLTEEQQQRIERNKQLALERRQAKLLSNSQTLGNDMLMNTPRAHTVEEVNTDEDQKEESNGLNEDILDNPCNDAIANTLNEEETLLDQSFKNVQQQLDATSRNITEAR

SEQ ID NO: 67152 - protein, 200 aa, Homo sapiens
MLIRHMEHWAHRLFPKLQFEDFIDRVEYLGSKKEVQTCLKRIRLDLPILHEDFVSNNDEVAENNEHDVTSTELDPFLTNLSESEMFASELSRSLTEEQQQRIERNKQLALERRQAKLLSNSQTLGNDMLMNTPRAHTVEEVNTDEDQKEESNGLNEDILDNPCNDAIANTLNEEETLLDQSFKNVQQQLDATSRNITEAR

SEQ ID NO: 67153 - protein, 178 aa, Homo sapiens
MMIHGFQSSHRDFCFGPWKLTASKTHIMKSADVEKLADELHMPSLPEMMFGDNVLRIQHGSGFGIEFNATDALRCVNNYQGMLKVACAEEWQESRTEGEHSKEVIKPYDWTYTTDYKGTLLGESLKLKVVPTTDHIDTEKLKAREQIKFFEEVLLFEDELHDHGVSSLSVKIPGGGHL

SEQ ID NO: 67154 - protein, 272 aa, Homo sapiens
MMIHGFQSSHRDFCFGPWKLTASKTHIMKSADVEKLADELHMPSLPEMMFGDNVLRIQHGSGFGIEFNATDALRCVNNYQGMLKVACAEEWQESRTEGEHSKEVIKPYDWTYTTDYKGTLLGESLKLKVVPTTDHIDTEKLKAREQIKFFEEVLLFEDELHDHGVSSLSVKIRVMPSSFFLLLRFFLRIDGVLIRMNDTRLYHEADKTYMLREYTSRESKISSLMHVPPSLFTEPNEISQYLPIKEAVCEKLIFPERIDPNPADSQKSTQVE

SEQ ID NO: 67155 - protein, 304 aa, Homo sapiens
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRKKQRVKIAYEEIFVKNM

SEQ ID NO: 67156 - protein, 251 aa, Homo sapiens
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFVTKEGTNDGWKNAAHIYQVFLNAFCIHASMFFLGLDSISCLC

SEQ ID NO: 67157 - protein, 304 aa, Homo sapiens; identical to SEQ ID NO: 67155

SEQ ID NO: 67158 - protein, 251 aa, Homo sapiens; identical to SEQ ID NO: 67156

SEQ ID NO: 67159 - protein, 76 aa, Homo sapiens
MIYTMKKVHALWASVCLLLNLAPAPLNADSEEDEEHTIITDTELPPLKLMHSFCAFKADDGPCKAIMKRFFFNIFT

SEQ ID NO: 67160 - protein, 61 aa, Homo sapiens
MIYTMKKVHALWASVCLLLNLAPAPLNADSEEDEEHTIITDTELPPLKLMHSFCAFKADDG

SEQ ID NO: 67161 - protein, 106 aa, Homo sapiens
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTR

SEQ ID NO: 67162 - protein, 288 aa, Homo sapiens
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRK

SEQ ID NO: 67163 - protein, 106 aa, Homo sapiens; identical to SEQ ID NO: 67161

SEQ ID NO: 67164 - protein, 105 aa, Homo sapiens
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCT

SEQ ID NO: 67165 - protein, 321 aa, Homo sapiens
MGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGEVTFDTTKSDGQFKKTASNSKLRTYLPDFRFTPFKQAVKETCAWFTDNYEQARK

SEQ ID NO: 67166 - protein, 119 aa, Homo sapiens
MGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFP

SEQ ID NO: 67167 - protein, 268 aa, Homo sapiens
MGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGE

SEQ ID NO: 67168 - protein, 321 aa, Homo sapiens; identical to SEQ ID NO: 67165

SEQ ID NO: 67169 - protein, 198 aa, Homo sapiens
MGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLA

SEQ ID NO: 67170 - protein, 885 aa, Homo sapiens
MVEKSSIDENSISLEKEVRHVQEQNLDILKTDLSLKSFSEEIYSESCALLPTSSADIEETDLSEKSCPLENGGRSSISHLKKAASEEKPLGVGEMEEECTLEPELAAFPKQDGGTQEYTDATLEDHRGDVQEADTLHRQLSLSQCFPLLMTEEQQNPGEQISTNIHASGEEKCYEEVQVQNEASFSTLEGEMIETSFSQNIPKLDEAHTTEAAESETSLTQYLLAAGKREVPETKDTRDQAKLVQSESITSMEVEEVTFNTVYEYYNQKQESLGRPLSPESDISIGVGSTTSEEISELDQFYTPPSSVEYFESPKSPDLYFNPSDITKQSSIHSGGETVERYSTPLGEVAERYSTPSEGEVGERYSTPPGETLERYSTPPGETLERYSTPPGEALERYSIPTGGPNPTGTFKTYPSKIEREDGTPNEHFYTPTEERGSAYEIWRSDSFGTPNEAIEPKDNEMPPSFIEPLTKRKVYENTTLGFIVEVEGLPVPGVKWYRNKSLLEPDERIKMERVGNVCSLEISNIQKGEGGEYMCHAVNIIGEAKSFANVDIMPQEERVVALPPPVTHQHVMEFDLEHTTSSRTPSPQEIVLEVELSEKDVKEFEKQVKIVTVPEFTPDHKSMIVSLDVLPFNFVDPNMDSREGEDKELKIDLEVFEMPPRFIMPICDFKIPENSDAVFKCSVIGIPTPEVKWYKEYMCIEPDNIKYVISEEKGSHTLKIRNVCLSDSATYRCRAVNCVGEAICRGFLTMGDSEIFAVIAKKSKVTLSSLMEELVLKSNYTDSFFEFQVVEGPPRFIKGISDCYAPIGTAAYFQCLVRGSPRPTVYWYKDGKLVQGRRFTVEESGTGFHNLFITSLVKSDEGEYRCVATNKSGMAESFAALTLT

SEQ ID NO: 67171 - protein, 5604 aa, Homo sapiens
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIRQETEITAASMVVVATAKSTKLETVPGAQEETTTQQDQMHLSYEKIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDSRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENMTSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEAPESILHERIEQEIEMEMKELFSEGESEHSERDTRDAFSDSEDIDHKSMAAKRYASRISSTSSWPEYFKPSFTQKLTFKYVLEGEPVVFTCRLIACPTPEMTWFHNNRPIPTGLRRIIKAESDLHHHSSSLEIKRVQDRDSGSYRLLAINSEGSAESTASLLVIQKGQDEKYLEFLKRAERTHENVEALVERGEDRIKVDLRFTGSPFNKKQDVEQKGMMRTIHFKTMSSAKKTDYMYDEEYLESKSDIRGWLNVGESFLDKETKVKLQRLREARKTLMEKKKLSLLDTSSEISSRTLRSEASDKDILFSREDMKIRSMSDLAESYKVDHSAESIVQNPHALSNQMDQNIESEELPTSFQTIVDEEIFQTEIRMSQEALVKESLPKDHLYGEILVNENTQARGQLEEIMANTTIGESSTYITNVCEKEEVYETPENVSQAITPHASESFGTLVNVEESEEIASERIKKDDLRELQLSASTRIDEFKTEQKEENMRFFENSFRKRPQRCPPSFLQEIESQEVYEGDSCNFVCHFQGYPQPIVTWYNNDMPIPRNQNFIIHSLENYSILTLSSVHHQNEGSITCVLFNQYGTVKTTSMLKVKAKQKHDVKAHKVPVFHDYLDEEEELALVFDQAKGAHPSMSQEGQTNLHLLKTNPPVPPSGDTELLSFPVEIQVTAATPIPEQDKESKEVFQTEELEPKAMPQDQVTQSPKHRFVFLSDITNEPPKMLQEMPKHARCREGDSIILECLISGEPQPVVTWFQNGVLLKQNQKFQFEEVNCSHQLYIKDVNSQDSGKYKCVAENNSGAVESVSDLTVEPVTYRENSQFENIGEIYGKYSRDQQLQDQGESVRAHFYDYPAGPFTPWTNVKEYSVRDYFQSLETIEQIDQKEQVRCIPSREKIPRFVHGASRTIKISKPIRAEFIQCQAEGKERHVSEKSKLHQAEGTVYPFVDDFSDVTIKKEIRNNFGKLGRSEKENVQECAQSDYLPNIHSERISDSYNTKDSSAIVYEESLGEEIHYPGKKVKHRIIEFEKLHVEKGVLEKRPTRTSIVNPPQKKIDDKAFSLKQRESRSSNLNANMYQAEKMSPNTESDSSNIAINLKLLSSQTHKEFDAQEREQQEKISLIDKPAISKRAEHESPITFDLKQFHTQIKHTDVKFQELDSGQPEEAYFKIQHPADTENIVFDLKQMYSHIGDPALEFQGQETREQQEIHYKEKIPSPETLQPDTHNISKSVQNNVFASQEISSSQELSNRTMVEKSSIDENSISLEKEVRHVQEQNLDILKTDLSLKSFSEEIYSESCALLPTSSADIEETDLSEKSCPLENGGRSSISHLKKAASEEKPLGVGEMEEECTLEPELAAFPKQDGGTQEYTDATLEDHRGDVQEADTLHRQLSLSQCFPLLMTEEQQNPGEQISTNIHASGEEKCYEEVQVQNEASFSTLEGEMIETSFSQNIPKLDEAHTTEAAESETSLTQYLLAAGKREVPETKDTRDQAKLVQSESITSMEVEEVTFNTVYEYYNQKQESLGRPLSPESDISIGVGSTTSEEISELDQFYTPPSSVEYFESPKSPDLYFNPSDITKQSSIHSGGETVERYSTPLGEVAERYSTPSEGEVGERYSTPPGETLERYSTPPGETLERYSTPPGETLERYSTPPGETLERYSTPPGETLERYSTPPGEALERYSIPTGGPNPTGTFKTYPSKIEREDGTPNEHFYTPTEERGSAYEIWRSDSFGTPNEAIEPKDNEMPPSFIEPLTKRKVYENTTLGFIVEVEGLPVPGVKWYRNKSLLEPDERIKMERVGNVCSLEISNIQKGEGGEYMCHAVNIIGEAKSFANVDIMPQEERVVALPPPVTHQHVMEFDLEHTTSSRTPSPQEIVLEVELSEKDVKEFEKQVKIVTVPEFTPDHKSMIVSLDVLPFNFVDPNMDSREGEDKELKIDLEVFEMPPRFIMPICDFKIPENSDAVFKCSVIGIPTPEVKWYKEYMCIEPDNIKYVISEEKGSHTLKIRNVCLSDSATYRCRAVNCVGEAICRGFLTMGDSEIFAVIAKKSKVTLSSLMEELVLKSNYTDSFFEFQVVEGPPRFIKGISDCYAPIGTAAYFQCLVRGSPRPTVYWYKDGKLVQGRRFTVEESGTGFHNLFITSLVKSDEGEYRCVATNKSGMAESFAALTLT

SEQ ID NO: 67172 - protein, 472 aa, Homo sapiens
MYIYEASEEAVLEEKVLVTQPQKTKPKLAKVPEPPKKVVPEDKIYVTIPKKRETPATKEPDTTRGIFPEVEPPEAIPEIPEHPPTEEFEVFKEVIPEGETPIVKRRKTPSPTAPEAMKEVVPEMKIFEDVPEEPETPRMKTPEAPQEIIPAKTVPSKKREPPSVKVPEALQEIVPEKKTLVVPLRKPEVLPDEVPEALREVVPEKKVHPPQRAEVVPVKVHEAPKEIIPEKKVSVVPPKKPEVPPVKVPEASKEVIREEKVPLAPPKEPEVPPVKVPEPPKEVVPEKKAPVAPPKEPEVPPVKVPEAPKEVVPEKKVPVPPPKKPEVPPTKVPEVPKAAVPEKKLPEAIPPKPESPPPEVPEVLPPKEVVPEKKVPVPPAKKPEAPPPKVPEAPKEVVLEKKASVAVPKKPEAPRAKVPEAAQEVVPEKKIPKAPIKKPEAPAVTVPEVPQEIVPEKKTLVLPKKPEVPPVT

SEQ ID NO: 67173 - protein, 373 aa, Homo sapiens [sequence omitted]

SEQ ID NO: 67174 - protein, 180 aa, Homo sapiens
KVPEVPKKPVLEEKPAVPVPERAESPPPEVYEEPEEIAPEEEIAPEEEKPVPVAEEEEPEVPPPAVPEEPKKIIPEKKVPVIKKPEAPPPKEPEPEKVIEKPKLKPRPPPPPPAPPKEDVKEKIFQLKAIPKKKVPEKPQVPEKVELTPLKVPGGEKKVRKLLPERKPEPKEEVVLKSGI

SEQ ID NO: 67175 - protein, 145 aa, Homo sapiens
EDTYQLEIAEAYPEDEGTYTFVASNAVGQVSSTANLSLEAPESILHERIEQEIEMEMKELFSEGESEHSERDTRDAFSDSEDIDHKSMAAKRYASRISSTSSWPEYFKPSFTQKLTFKYVLEGEPVVFTCRLIACPTPEMTWFHN

SEQ ID NO: 67176 - protein, 181 aa, Homo sapiens
MFFASHTEEEVSVTVPEVQKEIVTEEKIHVAISKRVEPPPKVPELPEKPAPEEVAPVPIPKKVEPPAPKVPEVPKKPVPEEKKPVPVPKKEPAAPPKVPEVPKKPVPEEKIPVPVAKKKEAPPAKVPEIPKKKVPEERKPVPRKEEEVPPPPKVPALPKKPVPEEKVAVPVPVAKKAPPPR

SEQ ID NO: 67177 - protein, 829 aa, Homo sapiens
VEEFIKLEQHRVEEEHRVEKVHRVIEVFEAEEVEVFEKPKAPPKGPEISEKIIPPKKPPTKVVPRKEPPAKVPEVPKKIVVEEKVRVPEEPRVPPTKAPEVPKKIVPEEKVREAVLKKPEVPPAKVPGMPKKSVQEEKSPIVISEDTEMYIYEASEEAVLEEKVLVTQPQKTKPKLAKVPEPPKKVVPEDKIYVTIPKKRETPATKEPDTTRGIFPEVEPPEAIPEIPEHPPTEEFEVFKEVIPEGETPIVKRRKTPSPTAPEAMKEVVPEMKIFEDVPEEPETPRMKTPEAPQEIIPAKTVPSKKREPPSVKVPEALQEIVPEKKTLVVPLRKPEVLPDEVPEALREVVPEKKVHPPQRAEVVPVKVHEAPKEIIPEKKVSVVPPKKPEVPPVKVPEASKEVIREEKVPLAPPKEPEVPPVKVPEPPKEVVPEKKAPVAPPKEPEVPPVKVPEAPKEVVPEKKVPVPPPKKPEVPPTKVPEVPKAAVPEKKLPEAIPPKPESPPPEVPEVLPPKEVVPEKKVPVPPAKKPEAPPPKVPEAPKEVVLEKKASVAVPKKPEAPRAKVPEAAQEVVPEKKIPKAPIKKPEAPAVTVPEVPQEIVPEKKTLVLPKKPEVPPVTVPEAPKEVVLEKKVPSAPPKKPEVPPVKVPEAPKEVVPEKKVPVPPPKKPEVPPTKVPEVPKAAVPEKKVPEAIPPKPESPPPEVPEVLPPKEVVPEKKVPVPPAKKPEAPPPKVPEAPKEVVLEKKASVAVPKKPEAPRAKVPEAAQEVVPEKKIPKAPIKKPEAPAVTVPEVPQEAAEKEIPVAPPKKPEAPIVPVPEAQEVVPEKK

SEQ ID NO: 67178 - protein, 167 aa, Homo sapiens
MATSELSCEVSEENCERREAFWAEWKDLTLSTRPEEGCSLHEEDTQRHETYHQQGQCQVLVQRSPWLMMRMGILGRGLQEYQLPYQRVLPLPIFTPAKMGATKEEREDTPIQLQELLALETALGGQCVDRQEVAEITKQLPPVVPVSKPGALRRSLSRSMSQEAQRG

SEQ ID NO: 67179 - protein, 247 aa, Homo sapiens
MAGGVLPLRGLRALCRVLLFLSQFCILSGGEQSQALAQSIKDPGPTRTFTVVPRAAESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 67180 - protein, 221 aa, Homo sapiens
MAGGVLPLRGLRALCRVLLFLSQFCILSGGESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 67181 - protein, 416 aa, Homo sapiens
MASSSGSSPRPAPDENEFPFGCPPTVCQDPKEPRALCCAGCLSENPRNGEDQICPKCRGEDLQSISPGSRLRTQEKAHPEVAEAGIGCPFAGVGCSFKGSPQSVQEHEVTSQTSHLNLLLGFMKQWKARLGCGLESGPMALEQNLSDLQLQAAVEVAGDLEVDCYRAPCSESQEELALQHFMKEKLLAELEGKLRVFENIVAVLNKEVEASHLALATSIHQSQLDRERILSLEQRVVELQQTLAQKDQALGKLEQSLRLMEEASFDGTFLWKITNVTRRCHESACGRTVSLFSPAFYTAKYGYKLCLRLYLNGDGTGKRTHLSLFIVIMRGEYDALLPWPFRNKVTFMLLDQNNREHAIDAFRPDLSSASFQRPQSETNVASGCPLFFPLSKLQSPKHAYVKDDTMFLKCIVETST

SEQ ID NO: 67182 - protein, 416 aa, Homo sapiens; identical to SEQ ID NO: 67181

SEQ ID NO: 67183 - protein, 294 aa, Homo sapiens
MKQWKARLGCGLESGPMALEQNLSDLQLQAAVEVAGDLEVDCYRAPCSESQEELALQHFMKEKLLAELEGKLRVFENIVAVLNKEVEASHLALATSIHQSQLDRERILSLEQRVVELQQTLAQKDQALGKLEQSLRLMEEASFDGTFLWKITNVTRRCHESACGRTVSLFSPAFYTAKYGYKLCLRLYLNGDGTGKRTHLSLFIVIMRGEYDALLPWPFRNKVTFMLLDQNNREHAIDAFRPDLSSASFQRPQSETNVASGCPLFFPLSKLQSPKHAYVKDDTMFLKCIVETST

SEQ ID NO: 67184 - protein, 691 aa, Homo sapiens
MNAAVVRRTQEALGKVIRRPPLTEKLLSKPPFRYLHDIITEVIRMTGFMKGLYTDAEMKSDNVKDKDAKISFLQKAIDVVVMVSGEPLLAKPARIVAGHEPERTNELLQIIGKCCLNKLSSDDAVRRVLAGEKGEVKGRASLTSRSQELDNKNVREEESRVHKNTEDRGDAEIKERSTSRDRKQKEELKEDRKPREKDKDKEKAKENGGNRHREGERERAKARARPDNERQKDRGNRERDRDSERKKETERKSEGGKEKERLRDRDRERDRDKGKDRDRRRVKNGEHSWDLDREKNREHDKPEKKSASSGEMSKKLSDGTFKDSKAETETEISTRASKSLTTKTSKRRSKNSVEGRKEDNISAKSLDSIVSGINNEPNQETTTSEIGTKEANINSTSISDDNSASLRCENIQPNPTEKQKGDSTSDAEGDAGPAGQDKSEVPETPEIPNELSSNIRRIPRPGSARPAPPRVKRQDSMEALQMDRSGSGKTVSNVITESHNSDNEEDDQFVVEAAPQLSEMSEIEMVTAVELEEEEKHGGLVKKILETKKDYEKLQQSPKPGEKERSLFESAWKKEKDIVSKEIEKLRTSIQTLCKSALPLGKIMDYIQEDVDAMQNELQMWHSENRQHAEALQQEQRITDCAVEPLKAELAELEQLIKDQQDKICAVKANILKNEEKIQKMVYSINLTSRR

SEQ ID NO: 67185 - protein, 625 aa, Homo sapiens
MNAAVVRRTQEALGKVIRRPPLTEKLLSKPPFRYLHDIITEVIRMTGFMKGLYTDAEMKSDNVKDKDAKISFLQKAIDVVVMVSGEPLLAKPARIVAGHEPERTNELLQIIGKCCLNKLSSDDAVRRVLAGEKGEVKGRASLTSRSQELDNKNVREEESRVHKNTEDRGDAEIKERSTSRDRKQKEELKEDRKPREKDKDKEKAKENGGNRHREGERERAKARARPDNERQKDRGNRERDRDSERKKETERKSEGGKEKERLRDRDRERDRDKGKDRDRRRVKNGEHSWDLDREKNREHDKPEKKSASSGEMSKKLSDGTFKDSKAETETEISTRASKSLTTKTSKRRSKNSVEGDSTSDAEGDAGPAGQDKSEVPETPEIPNELSSNIRRIPRPGSARPAPPRVKRQDSMEALQMDRSGSGKTVSNVITESHNSDNEEDDQFVVEAAPQLSEMSEIEMVTAVELEEEEKHGGLVKKILETKKDYEKLQQSPKPGEKERSLFESAWKKEKDIVSKEIEKLRTSIQTLCKSALPLGKIMDYIQEDVDAMQNELQMWHSENRQHAEALQQEQRITDCAVEPLKAELAELEQLIKDQQDKICAVKANILKNEEKIQKMVYSINLTSRR

SEQ ID NO: 67186 - protein, 691 aa, Homo sapiens
MNAAVVRRTQEALGKVIRRPPLTEKLLSKPPFRYLHDIITEVIRMTGFMKGLYTDAEMKSDNVKDKDAKISFLQKAIDVVVMVSGEPLLAKPARIVAGHEPERTNELLQIIGKCCLNKLSSDDAVRRVLAGEKGEVKGRASLTSRSQELDNKNVREEESRVHKNTEDRGDAEIKERSTSRDRKQKEELKEDRKPREKDKDKEKAKENGGNRHREGERERAKARARPDNERQKDRGNRERDRDSERKKETERKSEGGKEKERLRDRDRERDRDKGKDRDRRRVKNGEHSWDLDREKNREHDKPEKKSASSGEMSKKLSDGTFKDSKAETETEISTRASKSLTTKTSKRRSKNSVEGRKEDNISAKSLDSIVSGINNEPNQETTTSEIGTKEANINSTSISDDNSASLRCENIQPNPTEKQKGKNGSEREGDAGPAGQDKSEVPETPEIPNELSSNIRRIPRPGSARPAPPRVKRQDSMEALQMDRSGSGKTVSNVITESHNSDNEEDDQFVVEAAPQLSEMSEIEMVTAVELEEEEKHGGLVKKILETKKDYEKLQQSPKPGEKERSLFESAWKKEKDIVSKEIEKLRTSIQTLCKSALPLGKIMDYIQEDVDAMQNELQMWHSENRQHAEALQQEQRITDCAVEPLKAELAELEQLIKDQQDKICAVKANILKNEEKIQKMVYSINLTSRR

SEQ ID NO: 67187 - protein, 625 aa, Homo sapiens
MNAAVVRRTQEALGKVIRRPPLTEKLLSKPPFRYLHDIITEVIRMTGFMKGLYTDAEMKSDNVKDKDAKISFLQKAIDVVVMVSGEPLLAKPARIVAGHEPERTNELLQIIGKCCLNKLSSDDAVRRVLAGEKGEVKGRASLTSRSQELDNKNVREEESRVHKNTEDRGDAEIKERSTSRDRKQKEELKEDRKPREKDKDKEKAKENGGNRHREGERERAKARARPDNERQKDRGNRERDRDSERKKETERKSEGGKEKERLRDRDRERDRDKGKDRDRRRVKNGEHSWDLDREKNREHDKPEKKSASSGEMSKKLSDGTFKDSKAETETEISTRASKSLTTKTSKRRSKNSVEGTAKLILEGDAGPAGQDKSEVPETPEIPNELSSNIRRIPRPGSARPAPPRVKRQDSMEALQMDRSGSGKTVSNVITESHNSDNEEDDQFVVEAAPQLSEMSEIEMVTAVELEEEEKHGGLVKKILETKKDYEKLQQSPKPGEKERSLFESAWKKEKDIVSKEIEKLRTSIQTLCKSALPLGKIMDYIQEDVDAMQNELQMWHSENRQHAEALQQEQRITDCAVEPLKAELAELEQLIKDQQDKICAVKANILKNEEKIQKMVYSINLTSRR

SEQ ID NO: 67188 - protein, 557 aa, Homo sapiens
MAYSEEHKGMPCGFIRQNSGNSISLDFEPSIEYQFVERLEERYKCAFCHSVLHNPHQTGCGHRFCQHCILSLRELNTVPICPVDKEVIKSQEVFKDNCCKREVLNLYVYCSNAPGCNAKVILGRYQDHLQQCLFQPVQCSNEKCREPVLRKDLKEHLSASCQFRKEKCLYCKKDVVVINLQNHEENLCPEYPVFCPNNCAKIILKTEVDEHLAVCPEAEQDCPFKHYGCAVTDKRRNLQQHEHSALREHMRLVLEKNVQLEEQISDLHKSLEQKESKIQQLAETIKKLEKEFKQFAQLFGKNGSFLPNIQVFASHIDKSAWLEAQVHQLLQMVNQQQNKFDLRPLMEAVDTVKQKITLLENNDQRLAVLEEETNKHDTHINIHKAQLSKNEERFKLLEGTCYNGKLIWKVTDYKMKKREAVDGHTVSIFSQSFYTSRCGYRLCARAYLNGDGSGRGSHLSLYFVVMRGEFDSLLQWPFRQRVTLMLLDQSGKKNIMETFKPDPNSSSFKRPDGEMNIASGCPRFVAHSVLENAKNAYIKDDTLFLKVAVDLTDLEDL

SEQ ID NO: 67189 - protein, 557 aa, Homo sapiens; identical to SEQ ID NO: 67188

SEQ ID NO: 67190 - protein, 557 aa, Homo sapiens; identical to SEQ ID NO: 67188

SEQ ID NO: 67191 - protein, 451 aa, Homo sapiens
MAYSEEHKGMPCGFIRQNSGNSISLDFEPSIEYQFVERLEERYKCAFCHSVLHNPHQTGCGHRFCQHCILSLRELNTVPICPVDKEVIKSQEVFKDNCCKREVLNLYVYCSNAPGCNAKVILGRYQDKRRNLQQHEHSALREHMRLVLEKNVQLEEQISDLHKSLEQKESKIQQLAETIKKLEKEFKQFAQLFGKNGSFLPNIQVFASHIDKSAWLEAQVHQLLQMVNQQQNKFDLRPLMEAVDTVKQKITLLENNDQRLAVLEEETNKHDTHINIHKAQLSKNEERFKLLEGTCYNGKLIWKVTDYKMKKREAVDGHTVSIFSQSFYTSRCGYRLCARAYLNGDGSGRGSHLSLYFVVMRGEFDSLLQWPFRQRVTLMLLDQSGKKNIMETFKPDPNSSSFKRPDGEMNIASGCPRFVAHSVLENAKNAYIKDDTLFLKVAVDLTDLEDL

SEQ ID NO: 67192 - protein, 522 aa, Homo sapiens
MSLLNCENSCGSSQSESDCCVAMASSCSAVTKDDSVGGTASTGNLSSSFMEEIQGYDVEFDPPLESKYECPICLMALREAVQTPCGHRFCKACIIKSIRDAGHKCPVDNEILLENQLFPDNFAKREILSLMVKCPNEGCLHKMELRHLEDHQAHCEFALMDCPQCQRPFQKFHINIHILKDCPRRQVSCDNCAASMAFEDKEIHDQNCPLANVICEYCNTILIREQMPNHYDLDCPTAPIPCTFSTFGCHEKMQRNHLARHLQENTQSHMRMLAQAVHSLSVIPDSGYISEVRNFQETIHQLEGRLVRQDHQIRELTAKMETQSMYVSELKRTIRTLEDKVAEIEAQQCNGIYIWKIGNFGMHLKCQEEEKPVVIHSPGFYTGKPGYKLCMRLHLQLPTAQRCANYISLFVHTMQGEYDSHLPWPFQGTIRLTILDQSEAPVRQNHEEIMDAKPELLAFQRPTIPRNPKGFGYVTFMHLEALRQRTFIKDDTLLVRCEVSTRFDMGSLRREGFQPRSTDAGV

SEQ ID NO: 67193 - protein, 522 aa, Homo sapiens; identical to SEQ ID NO: 67192

SEQ ID NO: 67194 - protein, 670 aa, Homo sapiens
MSSGKSARYNRFSGGPSNLPTPDVTTGTRMETTFGPAFSAVTTITKADGTSTYKQHCRTPSSSSTLAYSPRDEEDSMPPISTPRRSDSAISVRSLHSESSMSLRSTFSLPEEEEEPEPLVFAEQPSVKLCCQLCCSVFKDPVITTCGHTFCRRCALKSEKCPVDNVKLTVVVNNIAVAEQIGELFIHCRHGCRVAGSGKPPIFEVDPRGCPFTIKLSARKDHEGSCDYRPVRCPNNPSCPPLLRMNLEAHLKECEHIKCPHSKYGCTFIGNQDTYETHLETCRFEGLKEFLQQTDDRFHEMHVALAQKDQEIAFLRSMLGKLSEKIDQLEKSLELKFDVLDENQSKLSEDLMEFRRDASMLNDELSHINARLNMGILGSYDPQQIFKCKGTFVGHQGPVWCLCVYSMGDLLFSGSSDKTIKVWDTCTTYKCQKTLEGHDGIVLALCIQGCKLYSGSADCTIIVWDIQNLQKVNTIRAHDNPVCTLVSSHNVLFSGSLKAIKVWDIVGTELKLKKELTGLNHWVRALVAAQSYLYSGSYQTIKIWDIRTLDCIHVLQTSGGSVYSIAVTNHHIVCGTYENLIHVWDIESKEQVRTLTGHVGTVYALAVISTPDQTKVFSASYDRSLRVWSMDNMICTQTLLRHQGSVTALAVSRGRLFSGAVDSTVKVWTC

SEQ ID NO: 67195 - protein, 704 aa, Homo sapiens
MARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 67196 - protein, 651 aa, Homo sapiens
MARELRALLLWGRRLRPLLRAPALAAVPGGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 67197 - protein, 636 aa, Homo sapiens
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPESPKNDREGPQ

SEQ ID NO: 67198 - protein, 636 aa, Homo sapiens; identical to SEQ ID NO: 67197

SEQ ID NO: 67199 - protein, 529 aa, Homo sapiens
MLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKPEYTWRLPCGGVRNPNQSSQVMDPPTARPTEPESPKNDREGPQ

SEQ ID NO: 67200 - protein, 635 aa, Homo sapiens
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPEPADLRLPRN

SEQ ID NO: 67201 - protein, 492 aa, Homo sapiens
MEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKGTHRGCPRHLPERKVK

SEQ ID NO: 67202 - protein, 144 aa, Homo sapiens [sequence omitted]

SEQ ID NO: 67203 - protein, 583 aa, Homo sapiens
MEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPESPKNDREGPQ

SEQ ID NO: 67204 - protein, 133 aa, Homo sapiens
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQ

SEQ ID NO: 67205 - protein, 636 aa, Homo sapiens; identical to SEQ ID NO: 67197

SEQ ID NO: 67206 - protein, 257 aa, Homo sapiens
MEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQR

SEQ ID NO: 67207 - protein, 636 aa, Homo sapiens; identical to SEQ ID NO: 67197

SEQ ID NO: 67208 - protein, 572 aa, Homo sapiens
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKPEYTWRLPCGGVRNPNQSSQVMDPPTARPTEPESPKNDREGPQ

SEQ ID NO: 67209 - protein, 635 aa, Homo sapiens; identical to SEQ ID NO: 67200

SEQ ID NO: 67210 - protein, 556 aa, Homo sapiens
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKSLQKMTVRGLSETRLCHLAPPSSCRAS

SEQ ID NO: 67211 - protein, 598 aa, Homo sapiens
MQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPESPKNDREGPQ

SEQ ID NO: 67212 - protein, 513 aa, Homo sapiens
MLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKSLQKMTVRGLSETRLCHLAPPSSCRAS

SEQ ID NO: 67213 - protein, 502 aa, Homo sapiens
MLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKGTHRGCPRHLPERKVK

SEQ ID NO: 67214 - protein, 429 aa, Homo sapiens
MSRDPGSGGWEEAPRAAAALCTLYHEAGQRLRRLQDQLAARDALIARLRARLAALEGDAAPSLVDALLEQVARFREQLRRQEGGAAEAQMRQEIERLTERLEEKEREMQQLLSQPQHEREKEVVLLRRSMAEGERARAASDVLCRSLANETHQLRRTLTATAHMCQHLAKCLDERQHAQRNVGERSPDQSEHTDGHTSVQSVIEKLQEENRLLKQKVTHVEDLNAKWQRYNASRDEYVRGLHAQLRGLQIPHEPELMRKEISRLNRQLEEKINDCAEVKQELAASRTARDAALERVQMLEQQILAYKDDFMSERADRERAQSRIQELEEKVASLLHQVSWRQDSREPDAGRIHAGSKTAKYLAADALELMVPGGWRPGTGSQQPEPPAEGGHPGAAQRGQGDLQCPHCLQCFSDEQGEELLRHVAECCQ

SEQ ID NO: 67215 - protein, 322 aa, Homo sapiens
MQQLLSQPQHEREKEVVLLRRSMAEGERARAASDVLCRSLANETHQLRRTLTATAHMCQHLAKCLDERQHAQRNVGERSPDQSEHTDGHTSVQSVIEKLQEENRLLKQKVTHVEDLNAKWQRYNASRDEYVRGLHAQLRGLQIPHEPELMRKEISRLNRQLEEKINDCAEVKQELAASRTARDAALERVQMLEQQILAYKDDFMSERADRERAQSRIQELEEKVASLLHQVSWRQDSREPDAGRIHAGSKTAKYLAADALELMVPGGWRPGTGSQQPEPPAEGGHPGAAQRGQGDLQCPHCLQCFSDEQGEELLRHVAECCQ

SEQ ID NO: 67216 - protein, 278 aa, Homo sapiens
MAEARSQPSAGPQLNALPDHSPLLQPGLAALRRRAREAGVPLAPLPLTDSFLLRFLRARDFDLDLAWRLLKNYYKWRAECPEISADLHPRSIIGLLKAGYHGVLRSRDPTGSKVLIYRIAHWDPKVFTAYDVFRVSLITSELIVQEVETQRNGIKAIFDLEGWQFSHAFQITPSVAKKIAAVLTDSFPLKVRGIHLINEPVIFHAVFSMIKPFLTEKIKERIHMHGNNYKQSLLQHFPDILPLEYGGEEFSMEDICQEWTNFIMKSEDYLSSISESIQ

SEQ ID NO: 67217 - protein, 786 aa, Homo sapiens
MTSIFHFAIIFMLILQIRIQLSEESEFLVDRSKNGLIHVPKDLSQKTTILNISQNYISELWTSDILSLSKLRILIISHNRIQYLDISVFKFNQELEYLDLSHNKLVKISCHPTVNLKHLDLSFNAFDALPICKEFGNMSQLKFLGLSTTHLEKSSVLPIAHLNISKVLLVLGETYGEKEDPEGLQDFNTESLHIVFPTNKEFHFILDVSVKTVANLELSNIKCVLEDNKCSYFLSILAKLQTNPKLSNLTLNNIETTWNSFIRILQLVWHTTVWYFSISNVKLQGQLDFRDFDYSGTSLKALSIHQVVSDVFGFPQSYIYEIFSNMNIKNFTVSGTRMVHMLCPSKISPFLHLDFSNNLLTDTVFENCGHLTELETLILQMNQLKELSKIAEMTTQMKSLQQLDISQNSVSYDEKKGDCSWTKSLLSLNMSSNILTDTIFRCLPPRIKVLDLHSNKIKSIPKQVVKLEALQELNVAFNSLTDLPGCGSFSSLSVLIIDHNSVSHPSADFFQSCQKMRSIKAGDNPFQCTCELGEFVKNIDQVSSEVLEGWPDSYKCDYPESYRGTLLKDFHMSELSCNITLLIVTIVATMLVLAVTVTSLCSYLDLPWYLRMVCQWTQTRRRARNIPLEELQRNLQFHAFISYSGHDSFWVKNELLPNLEKEGMQICLHERNFVPGKSIVENIITCIEKSYKSIFVLSPNFVQSEWCHYELYFAHHNLFHEGSNSLILILLEPIPQYSIPSSYHKLKSLMARRTYLEWPKEKSKRGLFWANLRAAINIKLTEQAKK

SEQ ID NO: 67218 - protein, 786 aa, Homo sapiens; identical to SEQ ID NO: 67217

SEQ ID NO: 67219 - protein, 161 aa, Homo sapiens
MTSIFHFAIIFMLILQIRIQLSEESEFLVDRSKNGLIHVPKDLSQKTTILNISQNYISELWTSDILSLSKLRILIISHNRIQYLDISVFKFNQELEYLDLSHNKLVKISCHPTVNLKHLDLSFNAFDALPICKEFGNMSQLKFLGLSTTHLEKSSVLPIAH

SEQ ID NO: 67220 - protein, 48 aa, Homo sapiens
MTSIFHFAIIFMLILQIRIQLSEESEFLVDRSKNGLIHVPKDLSQKTT

SEQ ID NO: 67221 - protein, 23 aa, Homo sapiens
MTSIFHFAIIFMLILQIRIQLSE

SEQ ID NO: 67222 - protein, 90 aa, Homo sapiens
MTSIFHFAIIFMLILQIRIQLSEESEFLVDRSKNGLIHVPKDLSQKTTILNISQNYISELWTSDILSLSKLRILIISHNRIQYLDISVFK

SEQ ID NO: 67223 - protein, 784 aa, Homo sapiens
MPHTLWMVWVLGVIISLSKEESSNQASLSCDRNGICKGSSGSLNSIPSGLTEAVKSLDLSNNRITYISNSDLQRCVNLQALVLTSNGINTIEEDSFSSLGSLEHLDLSYNYLSNLSSSWFKPLSSLTFLNLLGNPYKTLGETSLFSHLTKLQILRVGNMDTFTKIQRKDFAGLTFLEELEIDASDLQSYEPKSLKSIQNVSHLILHMKQHILLLEIFVDVTSSVECLELRDTDLDTFHFSELSTGETNSLIKKFTFRNVKITDESLFQVMKLLNQISGLLELEFDDCTLNGVGNFRASDNDRVIDPGKVETLTIRRLHIPRFYLFYDLSTLYSLTERVKRITVENSKVFLVPCLLSQHLKSLEYLDLSENLMVEEYLKNSACEDAWPSLQTLILRQNHLASLEKTGETLLTLKNLTNIDISKNSFHSMPETCQWPEKMKYLNLSSTRIHSVTGCIPKTLEILDVSNNNLNLFSLNLPQLKELYISRNKLMTLPDASLLPMLLVLKISRNAITTFSKEQLDSFHTLKTLEAGGNNFICSCEFLSFTQEQQALAKVLIDWPANYLCDSPSHVRGQQVQDVRLSVSECHRTALVSGMCCALFLLILLTGVLCHRFHGLWYMKMMWAWLQAKRKPRKAPSRNICYDAFVSYSERDAYWVENLMVQELENFNPPFKLCLHKRDFIPGKWIIDNIIDSIEKSHKTVFVLSENFVKSEWCKYELDFSHFRLFDENNDAAILILLEPIEKKAIPQRFCKLRKIMNTKTYLEWPMDEAQREGFWVNLRAAIKS

SEQ ID NO: 67224 - protein, 904 aa, Homo sapiens
MRQTLPCIYFWGGLLPFGMLCASSTTKCTVSHEVADCSHLKLTQVPDDLPTNITVLNLTHNQLRRLPAANFTRYSQLTSLDVGFNTISKLEPELCQKLPMLKVLNLQHNELSQLSDKTFAFCTNLTELHLMSNSIQKIKNNPFVKQKNLITLDLSHNGLSSTKLGTQVQLENLQELLLSNNKIQALKSEELDIFANSSLKKLELSSNQIKEFSPGCFHAIGRLFGLFLNNVQLGPSLTEKLCLELANTSIRNLSLSNSQLSTTSNTTFLGLKWTNLTMLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRGMFKSHCILNWPVQKERIGAFRHKLQVALGSKNSVH

SEQ ID NO: 67225 - protein, 627 aa, Homo sapiens
MLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRGMFKSHCILNWPVQKERIGAFRHKLQVALGSKNSVH

SEQ ID NO: 67226 - protein, 870 aa, Homo sapiens
MRQTLPCIYFWGGLLPFGMLCASSTTKCTVSHEVADCSHLKLTQVPDDLPTNITVLNLTHNQLRRLPAANFTRYSQLTSLDVGFNTISKLEPELCQKLPMLKVLNLQHNELSQLSDKTFAFCTNLTELHLMSNSIQKIKNNPFVKQKNLITLDLSHNGLSSTKLGTQVQLENLQELLLSNNKIQALKSEELDIFANSSLKKLELSSNQIKEFSPGCFHAIGRLFGLFLNNVQLGPSLTEKLCLELANTSIRNLSLSNSQLSTTSNTTFLGLKWTNLTMLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRAK

SEQ ID NO: 67227 - protein, 796 aa, Homo sapiens
MTKDKEPIVKSFHFVCLMIIIVGTRIQFSDGNEFAVDKSKRGLIHVPKDLPLKTKVLDMSQNYIAELQVSDMSFLSELTVLRLSHNRIQLLDLSVFKFNQDLEYLDLSHNQLQKISCHPIVSFRHLDLSFNDFKALPICKEFGNLSQLNFLGLSAMKLQKLDLLPIAHLHLSYILLDLRNYYIKENETESLQILNAKTLHLVFHPTSLFAIQVNISVNTLGCLQLTNIKLNDDNCQVFIKFLSELTRGSTLLNFTLNHIETTWKCLVRVFQFLWPKPVEYLNIYNLTIIESIREEDFTYSKTTLKALTIEHITNQVFLFSQTALYTVFSEMNIMMLTISDTPFIHMLCPHAPSTFKFLNFTQNVFTDSIFEKCSTLVKLETLILQKNGLKDLFKVGLMTKDMPSLEILDVSWNSLESGRHKENCTWVESIVVLNLSSNMLTDSVFRCLPPRIKVLDLHSNKIKSVPKQVVKLEALQELNVAFNSLTDLPGCGSFSSLSVLIIDHNSVSHPSADFFQSCQKMRSIKAGDNPFQCTCELREFVKNIDQVSSEVLEGWPDSYKCDYPESYRGSPLKDFHMSELSCNITLLIVTIGATMLVLAVTVTSLCIYLDLPWYLRMVCQWTQTRRRARNIPLEELQRNLQFHAFISYSEHDSAWVKSELVPYLEKEDIQICLHERNFVPGKSIVENIINCIEKSYKSIFVLSPNFVQSEWCHYELYFAHHNLFHEGSNNLILILLEPIPQNSIPNKYHKLKALMTQRTYLQWPKEKSKRGLFWANIRAAFNMKLTLVTENNDVKS

SEQ ID NO: 67228 - protein, 796 aa, Homo sapiens; identical to SEQ ID NO: 67227

SEQ ID NO: 67229 - protein, 150 aa, Homo sapiens
MTKDKEPIVKSFHFVCLMIIIVGTRIQFSDGNEFAVDKSKRGLIHVPKDLPLKTKVLDMSQNYIAELQVSDMSFLSELTVLRLSHNRIQLLDLSVFKFNQDLEYLDLSHNQLQKISCHPIVSFRHLDLSFNDFKALPICKEFGNLSQLNF

SEQ ID NO: 67230 - protein, 480 aa, Homo sapiens
MTKDKEPIVKSFHFVCLMIIIVGTRIQFSDGNEFAVDKSKRGLIHVPKDLPLKTKVLDMSQNYIAELQVSDMSFLSELTVLRLSHNRIQLLDLSVFKFNQDLEYLDLSHNQLQKISCHPIVSFRHLDLSFNDFKALPICKEFGNLSQLNFLGLSAMKLQKLDLLPIAHLHLSYILLDLRNYYIKENETESLQILNAKTLHLVFHPTSLFAIQVNISVNTLGCLQLTNIKLNDDNCQVFIKFLSELTRGSTLLNFTLNHIETTWKCLVRVFQFLWPKPVEYLNIYNLTIIESIREEDFTYSKTTLKALTIEHITNQVFLFSQTALYTVFSEMNIMMLTISDTPFIHMLCPHAPSTFKFLNFTQNVFTDSIFEKCSTLVKLETLIFVLSPNFVQSEWCHYELYFAHHNLFHEGSNNLILILLEPIPQNSIPNKYHKLKALMTQRTYLQWPKEKSKRGLFWANIRAAFNMKLTLVTENNDVKS

SEQ ID NO: 67231 - protein, 91 aa, Homo sapiens
MTKDKEPIVKSFHFVCLMIIIVGTRIQFSDGNEFAVDKSKRGLIHVPKDLPLKTKVLDMSQNYIAELQVSDMSFLSELTVLRLSHNRIQLL

SEQ ID NO: 67232 - protein, 1049 aa, Homo sapiens
MVFPMWTLKRQILILFNIILISKLLGARWFPKTLPCDVTLDVPKNHVIVDCTDKHLTEIPGGIPTNTTNLTLTINHIPDISPASFHRLDHLVEIDFRCNCVPIPLGSKNNMCIKRLQIKPRSFSGLTYLKSLYLDGNQLLEIPQGLPPSLQLLSLEANNIFSIRKENLTELANIEILYLGQNCYYRNPCYVSYSIEKDAFLNLTKLKVLSLKDNNVTAVPTVLPSTLTELYLYNNMIAKIQEDDFNNLNQLQILDLSGNCPRCYNAPFPCAPCKNNSPLQIPVNAFDALTELKVLRLHSNSLQHVPPRWFKNINKLQELDLSQNFLAKEIGDAKFLHFLPSLIQLDLSFNFELQVYRASMNLSQAFSSLKSLKILRIRGYVFKELKSFNLSPLHNLQNLEVLDLGTNFIKIANLSMFKQFKRLKVIDLSVNKISPSGDSSEVGFCSNARTSVESYEPQVLEQLHYFRYDKYARSCRFKNKEASFMSVNESCYKYGQTLDLSKNSIFFVKSSDFQHLSFLKCLNLSGNLISQTLNGSEFQPLAELRYLDFSNNRLDLLHSTAFEELHKLEVLDISSNSHYFQSEGITHMLNFTKNLKVLQKLMMNDNDISSSTSRTMESESLRTLEFRGNHLDVLWREGDNRYLQLFKNLLKLEELDISKNSLSFLPSGVFDGMPPNLKNLSLAKNGLKSFSWKKLQCLKNLETLDLSHNQLTTVPERLSNCSRSLKNLILKNNQIRSLTKYFLQDAFQLRYLDLSSNKIQMIQKTSFPENVLNNLKMLLLHHNRFLCTCDAVWFVWWVNHTEVTIPYLATDVTCVGPGAHKGQSVISLDLYTCELDLTNLILFSLSISVSLFLMVMMTASHLYFWDVWYIYHFCKAKIKGYQRLISPDCCYDAFIVYDTKDPAVTEWVLAELVAKLEDPREKHFNLCLEERDWLPGQPVLENLSQSIQLSKKTVFVMTDKYAKTENFKIAFYLSHQRLMDEKVDVIILIFLEKPFQKSKFLQLRKRLCGSSVLEWPTNPQAHPYFWQCLKNALATDNHVAYSQVFKETV

SEQ ID NO: 67233 - protein, 1041 aa, Homo sapiens
MENMFLQSSMLTCIFLLISGSCELCAEENFSRSYPCDEKKQNDSVIAECSNRRLQEVPQTVGKYVTELDLSDNFITHITNESFQGLQNLTKINLNHNPNVQHQNGNPGIQSNGLNITDGAFLNLKNLRELLLEDNQLPQIPSGLPESLTELSLIQNNIYNITKEGISRLINLKNLYLAWNCYFNKVCEKTNIEDGVFETLTNLELLSLSFNSLSHVPPKLPSSLRKLFLSNTQIKYISEEDFKGLINLTLLDLSGNCPRCFNAPFPCVPCDGGASINIDRFAFQNLTQLRYLNLSSTSLRKINAAWFKNMPHLKVLDLEFNYLVGEIASGAFLTMLPRLEILDLSFNYIKGSYPQHINISRNFSKLLSLRALHLRGYVFQELREDDFQPLMQLPNLSTINLGINFIKQIDFKLFQNFSNLEIIYLSENRISPLVKDTRQSYANSSSFQRHIRKRRSTDFEFDPHSNFYHFTRPLIKPQCAAYGKALDLSLNSIFFIGPNQFENLPDIACLNLSANSNAQVLSGTEFSAIPHVKYLDLTNNRLDFDNASALTELSDLEVLDLSYNSHYFRIAGVTHHLEFIQNFTNLKVLNLSHNNIYTLTDKYNLESKSLVELVFSGNRLDILWNDDDNRYISIFKGLKNLTRLDLSLNRLKHIPNEAFLNLPASLTELHINDNMLKFFNWTLLQQFPRLELLDLRGNKLLFLTDSLSDFTSSLRTLLLSHNRISHLPSGFLSEVSSLKHLDLSSNLLKTINKSALETKTTTKLSMLELHGNPFECTCDIGDFRRWMDEHLNVKIPRLVDVICASPGDQRGKSIVSLELTTCVSDVTAVILFFFTFFITTMVMLAALAHHLFYWDVWFIYNVCLAKVKGYRSLSTSQTFYDAYISYDTKDASVTDWVINELRYHLEESRDKNVLLCLEERDWDPGLAIIDNLMQSINQSKKTVFVLTKKYAKSWNFKTAFYLALQRLMDENMDVIIFILLEPVLQHSQYLRLRQRICKSSILQWPDNPKAEGLFWQTLRNVVLTENDSRYNNMYVDSIKQY

SEQ ID NO: 67234 - protein, 1059 aa, Homo sapiens
MKESSLQNSSCSLGKETKKENMFLQSSMLTCIFLLISGSCELCAEENFSRSYPCDEKKQNDSVIAECSNRRLQEVPQTVGKYVTELDLSDNFITHITNESFQGLQNLTKINLNHNPNVQHQNGNPGIQSNGLNITDGAFLNLKNLRELLLEDNQLPQIPSGLPESLTELSLIQNNIYNITKEGISRLINLKNLYLAWNCYFNKVCEKTNIEDGVFETLTNLELLSLSFNSLSHVPPKLPSSLRKLFLSNTQIKYISEEDFKGLINLTLLDLSGNCPRCFNAPFPCVPCDGGASINIDRFAFQNLTQLRYLNLSSTSLRKINAAWFKNMPHLKVLDLEFNYLVGEIASGAFLTMLPRLEILDLSFNYIKGSYPQHINISRNFSKLLSLRALHLRGYVFQELREDDFQPLMQLPNLSTINLGINFIKQIDFKLFQNFSNLEIIYLSENRISPLVKDTRQSYANSSSFQRHIRKRRSTDFEFDPHSNFYHFTRPLIKPQCAAYGKALDLSLNSIFFIGPNQFENLPDIACLNLSANSNAQVLSGTEFSAIPHVKYLDLTNNRLDFDNASALTELSDLEVLDLSYNSHYFRIAGVTHHLEFIQNFTNLKVLNLSHNNIYTLTDKYNLESKSLVELVFSGNRLDILWNDDDNRYISIFKGLKNLTRLDLSLNRLKHIPNEAFLNLPASLTELHINDNMLKFFNWTLLQQFPRLELLDLRGNKLLFLTDSLSDFTSSLRTLLLSHNRISHLPSGFLSEVSSLKHLDLSSNLLKTINKSALETKTTTKLSMLELHGNPFECTCDIGDFRRWMDEHLNVKIPRLVDVICASPGDQRGKSIVSLELTTCVSDVTAVILFFFTFFITTMVMLAALAHHLFYWDVWFIYNVCLAKVKGYRSLSTSQTFYDAYISYDTKDASVTDWVINELRYHLEESRDKNVLLCLEERDWDPGLAIIDNLMQSINQSKKTVFVLTKKYAKSWNFKTAFYLALQRLMDENMDVIIFILLEPVLQHSQYLRLRQRICKSSILQWPDNPKAEGLFWQTLRNVVLTENDSRYNNMYVDSIKQY

SEQ ID NO: 67235 - protein, 1032 aa, Homo sapiens
MGFCRSALHPLSLLVQAIMLAMTLALGTLPAFLPCELQPHGLVNCNWLFLKSVPHFSMAAPRGNVTSLSLSSNRIHHLHDSDFAHLPSLRHLNLKWNCPPVGLSPMHFPCHMTIEPSTFLAVPTLEELNLSYNNIMTVPALPKSLISLSLSHTNILMLDSASLAGLHALRFLFMDGNCYYKNPCRQALEVAPGALLGLGNLTHLSLKYNNLTVVPRNLPSSLEYLLLSYNRIVKLAPEDLANLTALRVLDVGGNCRRCDHAPNPCMECPRHFPQLHPDTFSHLSRLEGLVLKDSSLSWLNASWFRGLGNLRVLDLSENFLYKCITKTKAFQGLTQLRKLNLSFNYQKRVSFAHLSLAPSFGSLVALKELDMHGIFFRSLDETTLRPLARLPMLQTLRLQMNFINQAQLGIFRAFPGLRYVDLSDNRISGASELTATMGEADGGEKVWLQPGDLAPAPVDTPSSEDFRPNCSTLNFTLDLSRNNLVTVQPEMFAQLSHLQCLRLSHNCISQAVNGSQFLPLTGLQVLDLSHNKLDLYHEHSFTELPRLEALDLSYNSQPFGMQGVGHNFSFVAHLRTLRHLSLAHNNIHSQVSQQLCSTSLRALDFSGNALGHMWAEGDLYLHFFQGLSGLIWLDLSQNRLHTLLPQTLRNLPKSLQVLRLRDNYLAFFKWWSLHFLPKLEVLDLAGNQLKALTNGSLPAGTRLRRLDVSCNSISFVAPGFFSKAKELRELNLSANALKTVDHSWFGPLASALQILDVSANPLHCACGAAFMDFLLEVQAAVPGLPSRVKCGSPGQLQGLSIFAQDLRLCLDEALSWDCFALSLLAVALGLGVPMLHHLCGWDLWYCFHLCLAWLPWRGRQSGRDEDALPYDAFVVFDKTQSAVADWVYNELRGQLEECRGRWALRLCLEERDWLPGKTLFENLWASVYGSRKTLFVLAHTDRVSGLLRASFLLAQQRLLEDRKDVVVLVILSPDGRRSRYVRLRQRLCRQSVLLWPHQPSGQRSFWAQLGMALTRDNHHFYNRNFCQGPTAE

SEQ ID NO: 67236 - protein, 712 aa, Homo sapiens
MACTGPSLPSAFDILGAAGQDKLLYLKHKLKTPRPGCQGQDLLHAMVLLKLGQETEARISLEALKADAVARLVARQWAGVDSTEDPEEPPDVSWAVARLYHLLAEEKLCPASLRDVAYQEAVRTLSSRDDHRLGELQDEARNRCGWDIAGDPGSIRTLQSNLGCLPPSSALPSGTRSLPRPIDGVSDWSQGCSLRSTGSPASLASNLEISQSPTMPFLSLHRSPHGPSKLCDDPQASLVPEPVPGGCQEPEEMSWPPSGEIASPPELPSSPPPGLPEVAPDATSTGLPDTPAAPETSTNYPVECTEGSAGPQSLPLPILEPVKNPCSVKDQTPLQLSVEDTTSPNTKPCPPTPTTPETSPPPPPPPPSSTPCSAHLTPSSLFPSSLESSSEQKFYNFVILHARADEHIALRVREKLEALGVPDGATFCEDFQVPGRGELSCLQDAIDHSAFIILLLTSNFDCRLSLHQVNQAMMSNLTRQGSPDCVIPFLPLESSPAQLSSDTASLLSGLVRLDEHSQIFARKVANTFKPHRLQARKAMWRKEQDTRALREQSQHLDGERMQAAALNAAYSAYLQSYLSYQAQMEQLQVAFGSHMSFGTGAPYGARMPFGGQVPLGAPPPFPTWPGCPQPPPLHAWQAGTPPPPSPQPAAFPQSLPFPQSPAFPTASPAPPQSPGLQPLIIHHAQMVQLGLNNHMWNQRGSQAPEDKTQEAE

SEQ ID NO: 67237 - protein, 1013 aa, Homo sapiens
MGLGTLSPRMLVWLVASGIVFYGELWVCAGLDYDYTFDGNEEDKTETIDYKDPCKAAVFWGDIALDDEDLNIFQIDRTIDLTQNPFGNLGHTTGGLGDHAMSKKRGALYQLIDRIRRIGFGLEQNNTVKGKVPLQFSGQNEKNRVPRAATSRTERIWPGGVIPYVIGGNFTGSQRAMFKQAMRHWEKHTCVTFIERSDEESYIVFTYRPCGCCSYVGRRGNGPQAISIGKNCDKFGIVVHELGHVIGFWHEHTRPDRDNHVTIIRENIQPGQEYNFLKMEPGEVNSLGERYDFDSIMHYARNTFSRGMFLDTILPSRDDNGIRPAIGQRTRLSKGDIAQARKLYRCPACGETLQESNGNLSSPGFPNGYPSYTHCIWRVSVTPGEKIVLNFTTMDLYKSSLCWYDYIEVRDGYWRKSPLLGRFCGDKLPEVLTSTDSRMWIEFRSSSNWVGKGFAAVYEAICGGEIRKNEGQIQSPNYPDDYRPMKECVWKITVSESYHVGLTFQSFEIERHDNCAYDYLEVRDGTSENSPLIGRFCGYDKPEDIRSTSNTLWMKFVSDGTVNKAGFAANFFKEEDECAKPDRGGCEQRCLNTLGSYQCACEPGYELGPDRRSCEAACGGLLTKLNGTITTPGWPKEYPPNKNCVWQVVAPTQYRISVKFEFFELEGNEVCKYDYVEIWSGLSSESKLHGKFCGAEVPEVITSQFNNMRIEFKSDNTVSKKGFKAHFFSDKDECSKDNGGCQHECVNTMGSYMCQCRNGFVLHDNKHDCKEAECEQKIHSPSGLITSPNWPDKYPSRKECTWEISATPGHRIKLAFSEFEIEQHQECAYDHLEVFDGETEKSPILGRLCGNKIPDPLVATGNKMFVRFVSDASVQRKGFQATHSTECGGRLKAESKPRDLYSHAQFGDNNYPGQVDCEWLLVSERGSRLELSFQTFEVEEEADCGYDYVELFDGLDSTAVGLGRFCGSGPPEEIYSIGDSVLIHFHTDDTINKKGFHIRYKSIRYPDTTHTKK

SEQ ID NO: 67238 - protein, 392 aa, Homo sapiens
MGLGTLSPRMLVWLVASGIVFYGELWVCAGLDYDYTFDGNEEDKTETIDYKDPCKAAVFWGDIALDDEDLNIFQIDRTIDLTQNPFGNLGHTTGGLGDHAMSKKRGALYQLIDRIRRIGFGLEQNNTVKGKVPLQFSGQNEKNRVPRAATSRTERIWPGGVIPYVIGGNFTGSQRAMFKQAMRHWEKHTCVTFIERSDEESYIVFTYRPCGCCSYVGRRGNGPQAISIGKNCDKFGIVVHELGHVIGFWHEHTRPDRDNHVTIIRENIQPGQEYNFLKMEPGEVNSLGERYDFDSIMHYARNTFSRGMFLDTILPSRDDNGIRPAIGQRTRLSKGDIAQARKLYRCPACGETLQESNGNLSSPGFPNGYPSYTHCIWRVSVTPGEKVVFSLC

SEQ ID NO: 67239 - protein, 1015 aa, Homo sapiens
MPRATALGALVSLLLLLPLPRGAGGLGERPDATADYSELDGEEGTEQQLEHYHDPCKAAVFWGDIALDEDDLKLFHIDKARDWTKQTVGATGHSTGGLEEQASESSPDTTAMDTGTKEAGKDGRENTTLLHSPGTLHAAAKTFSPRVRRATTSRTERIWPGGVIPYVIGGNFTGSQRAIFKQAMRHWEKHTCVTFIERTDEESFIVFSYRTCGCCSYVGRRGGGPQAISIGKNCDKFGIVAHELGHVVGFWHEHTRPDRDQHVTIIRENIQPGQEYNFLKMEAGEVSSLGETYDFDSIMHYARNTFSRGVFLDTILPRQDDNGVRPTIGQRVRLSQGDIAQARKLYKCPACGETLQDTTGNFSAPGFPNGYPSYSHCVWRISVTPGEKIVLNFTSMDLFKSRLCWYDYVEVRDGYWRKAPLLGRFCGDKIPEPLVSTDSRLWVEFRSSSNILGKGFFAAYEATCGGDMNKDAGQIQSPNYPDDYRPSKECVWRITVSEGFHVGLTFQAFEIERHDSCAYDYLEVRDGPTEESALIGHFCGYEKPEDVKSSSNRLWMKFVSDGSINKAGFAANFFKEVDECSWPDHGGCEHRCVNTLGSYKCACDPGYELAADKKMCEVACGGFITKLNGTITSPGWPKEYPTNKNCVWQVVAPAQYRISLQFEVFELEGNDVCKYDFVEVRSGLSPDAKLHGRFCGSETPEVITSQSNNMRVEFKSDNTVSKRGFRAHFFSDKDECAKDNGGCQHECVNTFGSYLCRCRNGYWLHENGHDCKEAGCAHKISSVEGTLASPNWPDKYPSRRECTWNISSTAGHRVKLTFNEFEIEQHQECAYDHLEMYDGPDSLAPILGRFCGSKKPDPTVASGSSMFLRFYSDASVQRKGFQAVHSTECGGRLKAEVQTKELYSHAQFGDNNYPSEARCDWVIVAEDGYGVELTFRTFEVEEEADCGYDYMEAYDGYDSSAPRLGRFCGSGPLEEIYSAGDSLMIRFRTDDTINKKGFHARYTSTKFQDALHMKK

SEQ ID NO: 67240 - protein, 765 aa, Homo sapiens
MSGDHLHNDSQIEADFRLNDSHKHKDKHKDREHRHKEHKKEKDREKSKHSNSEHKDSEKKHKEKEKTKHKDGSSEKHKDKHKDRDKEKRKEEKVRASGDAKIKKEKENGFSSPPQIKDEPEDDGYFVPPKEDIKPLKRPRDEDDADYKPKKIKTEDTKKEKKRKLEEEEDGKLKKPKNKDKDKKVPEPDNKKKKPKKEEEQKWKWWEEERYPEGIKWKFLEHKGPVFAPPYEPLPENVKFYYDGKVMKLSPKAEEVATFFAKMLDHEYTTKEIFRKNFFKDWRKEMTNEEKNIITNLSKCDFTQMSQYFKAQTEARKQMSKEEKLKIKEENEKLLKEYGFCIMDNHKERIANFKIEPPGLFRGRGNHPKMGMLKRRIMPEDIIINCSKDAKVPSPPPGHKWKEVRHDNKVTWLVSWTENIQGSIKYIMLNPSSRIKGEKDWQKYETARRLKKCVDKIRNQYREDWKSKEMKVRQRAVALYFIDKLALRAGNEKEEGETADTVGCCSLRVEHINLHPELDGQEYVVEFDFLGKDSIRYYNKVPVEKRVFKNLQLFMENKQPEDDLFDRLNTGILNKHLQDLMEGLTAKVFRTYNASITLQQQLKELTAPDENIPAKILSYNRANRAVAILCNHQRAPPKTFEKSMMNLQTKIDAKKEQLADARRDLKSAKADAKVMKDAKTKKVVESKKKAVQRLEEQLMKLEVQATDREENKQIALGTSKLNYLDPRITVAWCKKWGVPIEKIYNKTQREKFAWAIDMADEDYEF

SEQ ID NO: 67241 - protein, 601 aa, Homo sapiens
MRVVRLLRLRAALTLLGEVPRRPASRGVPGSRRTQKGSGARWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTTTSLNKHLQELMDGLTAKVFRTYNASITLQEQLRALTRAEDSIAAKILSYNRANRVVAILCNHQRATPSTFEKSMQNLQTKIQAKKEQVAEARAELRRARAEHKAQGDGKSRSVLEKKRRLLEKLQEQLAQLSVQATDKEENKQVALGTSKLNYLDPRISIAWCKRFRVPVEKIYSKTQRERFAWALAMAGEDFEF

SEQ ID NO: 67242 - protein, 503 aa, Homo sapiens
MLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTTTSLNKHLQELMDGLTAKVFRTYNASITLQEQLRALTRAEDSIAAKILSYNRANRVVAILCNHQRATPSTFEKSMQNLQTKIQAKKEQVAEARAELRRARAEHKAQGDGKSRSVLEKKRRLLEKLQEQLAQLSVQATDKEENKQVALGTSKLNYLDPRISIAWCKRFRVPVEKIYSKTQRERFAWALAMAGEDFEF

SEQ ID NO: 67243 - protein, 503 aa, Homo sapiens; identical to SEQ ID NO: 67242

SEQ ID NO: 67244 - protein, 503 aa, Homo sapiens; identical to SEQ ID NO: 67242

SEQ ID NO: 67245 - protein, 1522 aa, Homo sapiens
MSRNDKEPFFVKFLKSSDNSKCFFKALESIKEFQSEEYLQIITEEEALKIKENDRSLYICDPFSGVVFDHLKKLGCRIVGPQVVIFCMHHQRCVPRAEHPVYNMVMSDVTISCTSLEKEKREEVHKYVQMMGGRVYRDLNVSVTHLIAGEVGSKKYLVAANLKKPILLPSWIKTLWEKSQEKKITRYTDINMEDFKCPIFLGCIICVTGLCGLDRKEVQQLTVKHGGQYMGQLKMNECTHLIVQEPKGQKYECAKRWNVHCVTTQWFFDSIEKGFCQDESIYKTEPRPEAKTMPNSSTPTSQINTIDSRTLSDVSNISNINASCVSESICNSLNSKLEPTLENLENLDVSAFQAPEDLLDGCRIYLCGFSGRKLDKLRRLINSGGGVRFNQLNEDVTHVIVGDYDDELKQFWNKSAHRPHVVGAKWLLECFSKGYMLSEEPYIHANYQPVEIPVSHKPESKAALLKKKNSSFSKKDFAPSEKHEQADEDLLSQYENGSSTVVEAKTSEARPFNDSTHAEPLNDSTHISLQEENQSSVSHCVPDVSTITEEGLFSQKSFLVLGFSNENESNIANIIKENAGKIMSLLSRTVADYAVVPLLGCEVEATVGEVVTNTWLVTCIDYQTLFDPKSNPLFTPVPVMTGMTPLEDCVISFSQCAGAEKESLTFLANLLGASVQEYFVRKSNAKKGMFASTHLILKERGGSKYEAAKKWNLPAVTIAWLLETARTGKRADESHFLIENSTKEERSLETEITNGINLNSDTAEHPGTRLQTHRKTVVTPLDMNRFQSKAFRAVVSQHARQVAASPAVGQPLQKEPSLHLDTPSKFLSKDKLFKPSFDVKDALAALETPGRPSQQKRKPSTPLSEVIVKNLQLALANSSRNAVALSASPQLKEAQSEKEEAPKPLHKVVVCVSKKLSKKQSELNGIAASLGADYRWSFDETVTHFIYQGRPNDTNREYKSVKERGVHIVSEHWLLDCAQECKHLPESLYPHTYNPKMSLDISAVQDGRLCNSRLLSAVSSTKDDEPDPLILEENDVDNMATNNKESAPSNGSGKNDSKGVLTQTLEMRENFQKQLQEIMSATSIVKPQGQRTSLSRSGCNSASSTPDSTRSARSGRSRVLEALRQSRQTVPDVNTEPSQNEQIIWDDPTAREERARLASNLQWPSCPTQYSELQVDIQNLEDSPFQKPLHDSEIAKQAVCDPGNIRVTEAPKHPISEELETPIKDSHLIPTPQAPSIAFPLANPPVAPHPREKIITIEETHEELKKQYIFQLSSLNPQERIDYCHLIEKLGGLVIEKQCFDPTCTHIVVGHPLRNEKYLASVAAGKWVLHRSYLEACRTAGHFVQEEDYEWGSSSILDVLTGINVQQRRLALAAMRWRKKIQQRQESGIVEGAFSGWKVILHVDQSREAGFKRLLQSGGAKVLPGHSVPLFKEATHLFSDLNKLKPDDSGVNIAEAAAQNVYCLRTEYIADYLMQESPPHVENYCLPEAISFIQNNKELGTGLSQKRKAPTEKNKIKRPRVH

SEQ ID NO: 67246 - protein, 1045 aa, Homo sapiens
MGSQPPLGSPLSREEGEAPPPAPASEGRRRSRRVRLRGSCRHRPSFLGCRELAASAPARPAPASSEIMASAAKEFKMDNFSPKAGTSKLQQTVPADASPDSKCPICLDRFDNVSYLDRCLHKFCFRCVQEWSKNKAECPLCKQPFDSIFHSVRAEDDFKEYVLRPSYNGSFVTPDRRFRYRTTLTRERNASVYSPSGPVNRRTTTPPDSGVLFEGLGISTRPRDVEIPQFMRQIAVRRPTTADERSLRKIQEQDIINFRRTLYRAGARVRNIEDGGRYRDISAEFFRRNPACLHRLVPWLKRELTVLFGAHGSLVNIVQHIIMSNVTRYDLESQAFVSDLRPFLLNRTEHFIHEFISFARSPFNMAAFDQHANYDCPAPSYEEGSHSDSSVITISPDEAETQELDINVATVSQAPWDDETPGPSYSSSEQVHVTMSSLLNTSDSSDEELVTGGATSQIQGVQTNDDLNNDSDDSSDNCVIVGFVKPLAERTPELVELSSDSEDLGSYEKMETVKTQEQEQSYSSGDSDVSRCSSPHSVLGKDEQINKGHCDSSTRIKSKKEEKRSTSLSSPRNLNSSVRGDRVYSPYNHRHRKRGRSRSSDSRSQSRSGHDQKNHRKHHGKKRMKSKRSRSRESSRPRGRRDKKRSRTRDSSWSRRSQTLSLSSESTSRSRSRSSDHGKRRSRSRNRDRYYLRNNYGSRYKWEYTYYSRNKDRDGYESSYRRRTLSRAHYSRQSSSPEFRVQSFSERTNARKKNNHSERKYYYYERHRSRSLSSNRSRTASTGTDRVRNEKPGGKRKYKTRHLEGTNEVAQPSREFASKAKDSHYQKSSSKLDGNYKNESDTFSDSRSSDRETKHKRRKRKTRSLSVEIVYEGKATDTTKHHKKKKKKHKKKHKKHHGDNASRSPVVITIDSDSDKDSEVKEDTECDNSGPQDPLQNEFLAPSLEPFETKDVVTIEAEFGVLDKECDIATLSNNLNNANKTVDNIPPLAASVEQTLDVREESTFVSDLENQPSNIVSLQTEPSRQLPSPRTSLMSVCLGRDCDMS

SEQ ID NO: 67247 - protein, 980 aa, Homo sapiens
MIMASAAKEFKMDNFSPKAGTSKLQQTVPADASPDSKCPICLDRFDNVSYLDRCLHKFCFRCVQEWSKNKAECPLCKQPFDSIFHSVRAEDDFKEYVLRPSYNGSFVTPDRRFRYRTTLTRERNASVYSPSGPVNRRTTTPPDSGVLFEGLGISTRPRDVEIPQFMRQIAVRRPTTADERSLRKIQEQDIINFRRTLYRAGARVRNIEDGGRYRDISAEFFRRNPACLHRLVPWLKRELTVLFGAHGSLVNIVQHIIMSNVTRYDLESQAFVSDLRPFLLNRTEHFIHEFISFARSPFNMAAFDQHANYDCPAPSYEEGSHSDSSVITISPDEAETQELDINVATVSQAPWDDETPGPSYSSSEQVHVTMSSLLNTSDSSDEELVTGGATSQIQGVQTNDDLNNDSDDSSDNCVIVGFVKPLAERTPELVELSSDSEDLGSYEKMETVKTQEQEQSYSSGDSDVSRCSSPHSVLGKDEQINKGHCDSSTRIKSKKEEKRSTSLSSPRNLNSSVRGDRVYSPYNHRHRKRGRSRSSDSRSQSRSGHDQKNHRKHHGKKRMKSKRSRSRESSRPRGRRDKKRSRTRDSSWSRRSQTLSLSSESTSRSRSRSSDHGKRRSRSRNRDRYYLRNNYGSRYKWEYTYYSRNKDRDGYESSYRRRTLSRAHYSRQSSSPEFRVQSFSERTNARKKNNHSERKYYYYERHRSRSLSSNRSRTASTGTDRVRNEKPGGKRKYKTRHLEGTNEVAQPSREFASKAKDSHYQKSSSKLDGNYKNESDTFSDSRSSDRETKHKRRKRKTRSLSVEIVYEGKATDTTKHHKKKKKKHKKKHKKHHGDNASRSPVVITIDSDSDKDSEVKEDTECDNSGPQDPLQNEFLAPSLEPFETKDVVTIEAEFGVLDKECDIATLSNNLNNANKTVDNIPPLAASVEQTLDVREESTFVSDLENQPSNIVSLQTEPSRQLPSPRTSLMSVCLGRDCDMS

SEQ ID NO: 67248 - protein, 332 aa, Homo sapiens
MKLGRAVLGLLLLAPSVVQAVEPISLGLALAGVLTGYIYPRLYCLFAECCGQKRSLSREALQKDLDDNLFGQHLAKKIILNAVFGFINNPKPKKPLTLSLHGWTGTGKNFVSKIIAENIYEGGLNSDYVHLFVATLHFPHASNITLYKDQLQLWIRGNVSACARSIFIFDEMDKMHAGLIDAIKPFLDYYDLVDGVSYQKAMFIFLSNAGAERITDVALDFWRSGKQREDIKLKDIEHALSVSVFNNKNSGFWHSSLIDRNLIDYFVPFLPLEYKHLKMCIRVEMQSRGYEIDEDIVSRVAEEMTFFPKEERVFSDKGCKTVFTKLDYYYDD

SEQ ID NO: 67249 - protein, 301 aa, Homo sapiens
MKLGRAVLGLLLLAPSVVQAVEPISLGLALAGVLTGYIYPRLYCLFAECCGQKRSLSREALQKDLDDNLFGQHLAKKIILNAVFGFINNPKPKKPLTLSLFVATLHFPHASNITLYKDQLQLWIRGNVSACARSIFIFDEMDKMHAGLIDAIKPFLDYYDLVDGVSYQKAMFIFLSNAGAERITDVALDFWRSGKQREDIKLKDIEHALSVSVFNNKNSGFWHSSLIDRNLIDYFVPFLPLEYKHLKMCIRVEMQSRGYEIDEDIVSRVAEEMTFFPKEERVFSDKGCKTVFTKLDYYYDD

SEQ ID NO: 67250 - protein, 336 aa, Homo sapiens
MLRAGWLRGAAALALLLAARVVAAFEPITVGLAIGAASAITGYLSYNDIYCRFAECCREERPLNASALKLDLEEKLFGQHLATEVIFKALTGFRNNKNPKKPLTLSLHGWAGTGKNFVSQIVAENLHPKGLKSNFVHLFVSTLHFPHEQKIKLYQDQLQKWIRGNVSACANSVFIFDEMDKLHPGIIDAIKPFLDYYEQVDGVSYRKAIFIFLSNAGGDLITKTALDFWRAGRKREDIQLKDLEPVLSVGVFNNKHSGLWHSGLIDKNLIDYFIPFLPLEYRHVKMCVRAEMRARGSAIDEDIVTRVAEEMTFFPRDEKIYSDKGCKTVQSRLDFH

SEQ ID NO: 67251 - protein, 141 aa, Homo sapiens
  MOD_RES (1)..(1): Any amino acid
XRVVAAFEPITVGLAIGAASAITGYLSYNDIYCRFAECCREERPLNASALKLDLEEKLFGQHLATEVIFKALTGFRNNKNPKKPLTLSLHGWAGTGKNFVSQIVAENLHPKGLKSNFVHLFVSTLHFPHEQKIKLYQSSLT

SEQ ID NO: 67252 - protein, 305 aa, Homo sapiens
MLRAGWLRGAAALALLLAARVVAAFEPITVGLAIGAASAITGYLSYNDIYCRFAECCREERPLNASALKLDLEEKLFGQHLATEVIFKALTGFRNNKNPKKPLTLSLFVSTLHFPHEQKIKLYQDQLQKWIRGNVSACANSVFIFDEMDKLHPGIIDAIKPFLDYYEQVDGVSYRKAIFIFLSNAGGDLITKTALDFWRAGRKREDIQLKDLEPVLSVGVFNNKHSGLWHSGLIDKNLIDYFIPFLPLEYRHVKMCVRAEMRARGSAIDEDIVTRVAEEMTFFPRDEKIYSDKGCKTVQSRLDFH

SEQ ID NO: 67253 - protein, 336 aa, Homo sapiens
MLRGPWRQLWLFFLLLLPGAPEPRGASRPWEGTDEPGSAWAWPGFQRLQEQLRAAGALSKRYWTLFSCQVWPDDCDEDEEAATGPLGWRLPLLGQRYLDLLTTWYCSFKDCCPRGDCRISNNFTGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPEGHRAESPWTIFLFLSNLRGDIINEVVLKLLKAGWSREEITMEHLEPHLQAEIVETIGFSFLTTRWPHLDLPTSSVAPT

SEQ ID NO: 67254 - protein, 153 aa, Homo sapiens
MLRGPWRQLWLFFLLLLPGAPEPRGASRPWEGTDEPGSAWAWPGFQRLQEQLRAAGALSKRYWTLFSCQVWPDDCDEDEEAATGPLGWRLPLLGQRYLDLLTTWYCSFKDCCPRGDCRISNNFTGKNFVARMLVENLYRDGLMSDCVRMFIAT

SEQ ID NO: 67255 - protein, 397 aa, Homo sapiens
MLRGPWRQLWLFFLLLLPGAPEPRGASRPWEGTDEPGSAWAWPGFQRLQEQLRAAGALSKRYWTLFSCQVWPDDCDEDEEAATGPLGWRLPLLGQRYLDLLTTWYCSFKDCCPRGDCRISNNFTGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPEGHRAESPWTIFLFLSNLRGDIINEVVLKLLKAGWSREEITMEHLEPHLQAEIVETIDNGFGHSRLVKENLIDYFIPFLPLEYRHVRLCARDAFLSQELLYKEETLDEIAQMMVYVPKEEQLFSSQGCKSISQRINYFLS

SEQ ID NO: 67256 - protein, 174 aa, Homo sapiens
MGLCVPFAVTTSFLSLGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPEGHRAESPWTIFLFLSNLRGDIINE

SEQ ID NO: 67257 - protein, 621 aa, Homo sapiens
MEFPGGNDNYLTITGPSHPFLSGAETFHTPSLGDEEFEIPPISLDSDPSLAVSDVVGHFDDLADPSSSQDGSFSAQYGVQTLDMPVGMTHGLMEQGGGLLSGGLTMDLDHSIGTQYSANPPVTIDVPMTDMTSGLMGHSQLTTIDQSELSSQLGLSLGGGTILPPAQSPEDRLSTTPSPTSSLHEDGVEDFRRQLPSQKTVVVEAGKKQKAPKKRKKKDPNEPQKPVSAYALFFRDTQAAIKGQNPNATFGEVSKIVASMWDSLGEEQKQVYKRKTEAAKKEYLKALAAYKDNQECQATVETVELDPAPPSQTPSPPPMATVDPASPAPASIEPPALSPSIVVNSTLSSYVANQASSGAGGQPNITKLIITKQMLPSSITMSQGGMVTVIPATVVTSRGLQLGQTSTATIQPSQQAQIVTRSVLQAAAAAAAAASMQLPPPRLQPPPLQQMPQPPTQQQVTILQQPPPLQAMQQPPPQKVRINLQQQPPPLQIKSVPLPTLKMQTTLVPPTVESSPERPMNNSPEAHTVEAPSPETICEMITDVVPEVESPSQMDVELVSGSPVALSPQPRCVRSGCENPPIVSKDWDNEYCSNECVVKHCRDVFLAWVASRNSNTVVFVK

SEQ ID NO: 67258 - protein, 621 aa, Homo sapiens; identical to SEQ ID NO: 67257

SEQ ID NO: 67259 - protein, 598 aa, Homo sapiens
METFHTPSLGDEEFEIPPISLDSDPSLAVSDVVGHFDDLADPSSSQDGSFSAQYGVQTLDMPVGMTHGLMEQGGGLLSGGLTMDLDHSIGTQYSANPPVTIDVPMTDMTSGLMGHSQLTTIDQSELSSQLGLSLGGGTILPPAQSPEDRLSTTPSPTSSLHEDGVEDFRRQLPSQKTVVVEAGKKQKAPKKRKKKDPNEPQKPVSAYALFFRDTQAAIKGQNPNATFGEVSKIVASMWDSLGEEQKQVYKRKTEAAKKEYLKALAAYKDNQECQATVETVELDPAPPSQTPSPPPMATVDPASPAPASIEPPALSPSIVVNSTLSSYVANQASSGAGGQPNITKLIITKQMLPSSITMSQGGMVTVIPATVVTSRGLQLGQTSTATIQPSQQAQIVTRSVLQAAAAAAAAASMQLPPPRLQPPPLQQMPQPPTQQQVTILQQPPPLQAMQQPPPQKVRINLQQQPPPLQIKSVPLPTLKMQTTLVPPTVESSPERPMNNSPEAHTVEAPSPETICEMITDVVPEVESPSQMDVELVSGSPVALSPQPRCVRSGCENPPIVSKDWDNEYCSNECVVKHCRDVFLAWVASRNSNTVVFVK

SEQ ID NO: 67260 - protein, 549 aa, Homo sapiens
MRNLKSHLSPWILIPHWLSQMWLATLMTWQFFSPDLDHSIGTQYSANPPVTIDVPMTDMTSGLMGHSQLTTIDQSELSSQLGLSLGGGTILPPAQSPEDRLSTTPSPTSSLHEDGVEDFRRQLPSQKTVVVEAGKKQKAPKKRKKKDPNEPQKPVSAYALFFRDTQAAIKGQNPNATFGEVSKIVASMWDSLGEEQKQVYKRKTEAAKKEYLKALAAYKDNQECQATVETVELDPAPPSQTPSPPPMATVDPASPAPASIEPPALSPSIVVNSTLSSYVANQASSGAGGQPNITKLIITKQMLPSSITMSQGGMVTVIPATVVTSRGLQLGQTSTATIQPSQQAQIVTRSVLQAAAAAAAAASMQLPPPRLQPPPLQQMPQPPTQQQVTILQQPPPLQAMQQPPPQKVRINLQQQPPPLQIKSVPLPTLKMQTTLVPPTVESSPERPMNNSPEAHTVEAPSPETICEMITDVVPEVESPSQMDVELVSGSPVALSPQPRCVRSGCENPPIVSKDWDNEYCSNECVVKHCRDVFLAWVASRNSNTVVFVK

SEQ ID NO: 67261 - protein, 339 aa, Homo sapiens
MMPFCHNIINISCVKNNWSNDVRASLYSLMVLIILTTLVGNLIVIVSISHFKQLHTPTNWLIHSMATVDFLLGCLVMPYSMVRSAEHCWYFGEVFCKIHTSTDIMLSSASIFHLSFISIDRYYAVCDPLRYKAKMNILVICVMIFISWSVPAVFAFGMIFLELNFKGAEEIYYKHVHCRGGCSVFFSKISGVLTFMTSFYIPGSIMLCVYYRIYLIAKEQARLISDANQKLQIGLEMKNGISQSKERKAVKTLGIVMGVFLICWCPFFICTVMDPFLHYIIPPTLNDVLIWFGYLNSTFNPMVYAFFYPWFRKALKMMLFGKIFQKDSSRCKLFLELSS

SEQ ID NO: 67262 - protein, 306 aa, Homo sapiens
MYSFMAGSIFITIFGNLAMIISISYFKQLHTPTNFLILSMAITDFLLGFTIMPYSMIRSVENCWYFGLTFCKIYYSFDLMLSITSIFHLCSVAIDRFYAICYPLLYSTKITIPVIKRLLLLCWSVPGAFAFGVVFSEAYADGIEGYDILVACSSSCPVMFNKLWGTTLFMAGFFTPGSMMVGIYGKIFAVSRKHAHAINNLRENQNNQVKKDKKAAKTLGIVIGVFLLCWFPCFFTILLDPFLNFSTPVVLFDALTWFGYFNSTCNPLIYGFFYPWFRRALKYILLGKIFSSCFHNTILCMQKESE

SEQ ID NO: 67263 - protein, 351 aa, Homo sapiens
MAVSSEQHELSHFKRTQTKKEKFNCSEYGNRSCPENERSLGVRVAMYSFMAGSIFITIFGNLAMIISISYFKQLHTPTNFLILSMAITDFLLGFTIMPYSMIRSVENCWYFGLTFCKIYYSFDLMLSITSIFHLCSVAIDRFYAICYPLLYSTKITIPVIKRLLLLCWSVPGAFAFGVVFSEAYADGIEGYDILVACSSSCPVMFNKLWGTTLFMAGFFTPGSMMVGIYGKIFAVSRKHAHAINNLRENQNNQVKKDKKAAKTLGIVIGVFLLCWFPCFFTILLDPFLNFSTPVVLFDALTWFGYFNSTCNPLIYGFFYPWFRRALKYILLGKIFSSCFHNTILCMQKESE

SEQ ID NO: 67264 - protein, 306 aa, Homo sapiens; identical to SEQ ID NO: 67262

SEQ ID NO: 67265 - protein, 345 aa, Homo sapiens
MSSNSSLLVAVQLCYANVNGSCVKIPFSPGSRVILYIVFGFGAVLAVFGNLLVMISILHFKQLHSPTNFLVASLACADFLVGVTVMPFSMVRTVESCWYFGRSFCTFHTCCDVAFCYSSLFHLCFISIDRYIAVTDPLVYPTKFTVSVSGICISVSWILPLMYSGAVFYTGVYDDGLEELSDALNCIGGCQTVVNQNWVLTDFLSFFIPTFIMIILYGNIFLVARRQAKKIENTGSKTESSSESYKARVARRERKAAKTLGVTVVAFMISWLPYSIDSLIDAFMGFITPACIYEICCWCAYYNSAMNPLIYALFYPWFRKAIKVIVTGQVLKNSSATMNLFSEHI

SEQ ID NO: 67266 - protein, 318 aa, Homo sapiens
VNGSCVKIPFSPGSRVILYIVFGFGAVLAVFGNLLVMISILHFKQLHSPTNFLVASLACADFLVGVTVMPFSMVRTVESCWYFGRSFCTFHTCCDVAFCYSSLFHLCFISIDRYIAVTDPLVYPTKFTVSVSGICISVSWILPLMYSGAVFYTGVYDDGLEELSDALNCIGGCQTVVNQNWVLTDFLSFFIPTFIMIILYGNIFLVARRQAKKIENTESYKARVARRERKAAKTLGVTVVAFMISWLPYSIDSLIDAFMGFITPACIYEICCWCAYYNSAMNPLIYALFYPWFRKAIKVIVTGQVLKNSSATMNLFSE

SEQ ID NO: 67267 - protein, 469 aa, Homo sapiens
MPIRALCTICSDFFDHSRDVAAIHCGHTFHLQCLIQWFETAPSRTCPQCRIQVGKRTIINKLFFDLAQEEENVLDAEFLKNELDNVRAQLSQKDKEKRDSQVIIDTLRDTLEERNATVVSLQQALGKAEMLCSTLKKQMKYLEQQQDETKQAQEEARRLRSKMKTMEQIELLLQSQRPEVEEMIRDMGVGQSAVEQLAVYCVSLKKEYENLKEARKASGEVADKLRKDLFSSRSKLQTVYSELDQAKLELKSAQKDLQSADKEIMSLKKKLTMLQETLNLPPVASETVDRLVLESPAPVEVNLKLRRPSFRDDIDLNATFDVDTPPARPSSSQHGYYEKLCLEKSHSPIQDVPKKICKGPRKESQLSLGGQSCAGEPDEELVGAFPIFVRNAILGQKQPKRPRSESSCSKDVVRTGFDGLGGRTKFIQPTDTVMIRPLPVKPKTKVKQRVRVKTVPSLFQAKLDTFLWS

SEQ ID NO: 67268 - protein, 1352 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYIRRQLEEEQRQLEILQQQLLHEQALLLEYKRKQLEEQRQAERLQRQLKQERDYLVSLQHQRQEQRPVEKKPLYHYKEGMSPSEKPAWAKEVEERSRLNRQSSPAMPHKVANRISDPNLPPRSESFSISGVQPARTPPMLRPVDPQIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPADLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 67269 - protein, 1276 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYKRKQLEEQRQAERLQRQLKQERDYLVSLQHQRQEQRPVEKKPLYHYKEGMSPSEKPAWAKEIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPASYKKAIDEDLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 67270 - protein, 1331 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYKRKQLEEQRQAERLQRQLKQERDYLVSLQHQRQEQRPVEKKPLYHYKEGMSPSEKPAWAKEVEERSRLNRQSSPAMPHKVANRISDPNLPPRSESFSISGVQPARTPPMLRPVDPQIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPASYKKAIDEDLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 67271 - protein, 1338 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKIVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYKRKQLEEQRQAERLQRQLKQERDYLVSLQHQRQEQRPVEKKPLYHYKEGMSPSEKPAWAKEVEERSRLNRQSSPAMPHKVANRISDPNLPPRSESFSISGVQPARTPPMLRPVDPQIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPAVSAFLSKSFELLIYQDLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 67272 - protein, 1360 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYIRRQLEEEQRQLEILQQQLLHEQALLLEYKRKQLEEQRQAERLQRQLKQERDYLVSLQHQRQEQRPVEKKPLYHYKEGMSPSEKPAWAKEVEERSRLNRQSSPAMPHKVANRISDPNLPPRSESFSISGVQPARTPPMLRPVDPQIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPASYKKAIDEDLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 67273 - protein, 1297 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYIRRQLEEEQRQLEILQQQLLHEQALLLEYKRKQLEEQRQAERLQRQLKQERDYLVSLQHQRQEQRPVEKKPLYHYKEGMSPSEKPAWAKEIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPADLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 67274 - protein, 1323 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYKRKQLEEQRQAERLQRQLKQERDYLVSLQHQRQEQRPVEKKPLYHYKEGMSPSEKPAWAKEVEERSRLNRQSSPAMPHKVANRISDPNLPPRSESFSISGVQPARTPPMLRPVDPQIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPADLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 67275 - protein, 1268 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYKRKQLEEQRQAERLQRQLKQERDYLVSLQHQRQEQRPVEKKPLYHYKEGMSPSEKPAWAKEIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPADLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 67276 - protein, 1305 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYIRRQLEEEQRQLEILQQQLLHEQALLLEYKRKQLEEQRQAERLQRQLKQERDYLVSLQHQRQEQRPVEKKPLYHYKEGMSPSEKPAWAKEIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPASYKKAIDEDLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 67277 - protein, 1312 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKIVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYIRRQLEEEQRQLEILQQQLLHEQALLLEYKRKQLEEQRQAERLQRQLKQERDYLVSLQHQRQEQRPVEKKPLYHYKEGMSPSEKPAWAKEIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPAVSAFLSKSFELLIYQDLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 67278 - protein, 574 aa, Homo sapiens
MPPQLQETRMNRSIPVEVDESEPYPSQLLKPIPEYSPEEESEPPAPNIRNMAPNSLSAPTMLHNSSGDFSQAHSTLKLANHQRPVSRQVTCLRTQVLEDSEDSFCRRHPGLGKAFPSGCSAVSEPASESVVGALPAEHQFSFMEKRNQWLVSQLSAASPDTGHDSDKSDQSLPNASADSLGGSQEMVQRPQPHRNRAGLDLPTIDTGYDSQPQDVLGIRQLERPLPLTSVCYPQDLPRPLRSREFPQFEPQRYPACAQMLPPNLSPHAPWNYHYHCPGSPDHQVPYGHDYPRAAYQQVIQPALPGQPLPGASVRGLHPVQKVILNYPSPWDHEERPAQRDCSFPGLPRHQDQPHHQPPNRAGAPGESLECPAELRPQVPQPPSPAAVPRPPSNPPARGTLKTSNLPEELRKVFITYSMDTAMEVVKFVNFLLVNGFQTAIDIFEDRIRGIDIIKWMERYLRDKTVMIIVAISPKYKQDVEGAESQLDEDEHGLHTKYIHRMMQIEFIKQGSMNFRFIPVLFPNAKKEHVPTWLQNTHVYSWPKNKKNILLRLLREEEYVAPPRGPLPTLQVVPL

SEQ ID NO: 67279 - protein, 564 aa, Homo sapiens
MNRSIPVEVDESEPYPSQLLKPIPEYSPEEESEPPAPNIRNMAPNSLSAPTMLHNSSGDFSQAHSTLKLANHQRPVSRQVTCLRTQVLEDSEDSFCRRHPGLGKAFPSGCSAVSEPASESVVGALPAEHQFSFMEKRNQWLVSQLSAASPDTGHDSDKSDQSLPNASADSLGGSQEMVQRPQPHRNRAGLDLPTIDTGYDSQPQDVLGIRQLERPLPLTSVCYPQDLPRPLRSREFPQFEPQRYPACAQMLPPNLSPHAPWNYHYHCPGSPDHQVPYGHDYPRAAYQQVIQPALPGQPLPGASVRGLHPVQKVILNYPSPWDHEERPAQRDCSFPGLPRHQDQPHHQPPNRAGAPGESLECPAELRPQVPQPPSPAAVPRPPSNPPARGTLKTSNLPEELRKVFITYSMDTAMEVVKFVNFLLVNGFQTAIDIFEDRIRGIDIIKWMERYLRDTVMIIVAISPKYKQDVEGAESQLDEDEHGLHTKYIHRMMQIEFIKQGSMNFRFIPVLFPNAKKEHVPTWLQNTHVYSWPKNKKNILLRLLREEEYVAPPRGPLPTLQVVPL

SEQ ID NO: 67280 - protein, 565 aa, Homo sapiens
MNRSIPVEVDESEPYPSQLLKPIPEYSPEEESEPPAPNIRNMAPNSLSAPTMLHNSSGDFSQAHSTLKLANHQRPVSRQVTCLRTQVLEDSEDSFCRRHPGLGKAFPSGCSAVSEPASESVVGALPAEHQFSFMEKRNQWLVSQLSAASPDTGHDSDKSDQSLPNASADSLGGSQEMVQRPQPHRNRAGLDLPTIDTGYDSQPQDVLGIRQLERPLPLTSVCYPQDLPRPLRSREFPQFEPQRYPACAQMLPPNLSPHAPWNYHYHCPGSPDHQVPYGHDYPRAAYQQVIQPALPGQPLPGASVRGLHPVQKVILNYPSPWDHEERPAQRDCSFPGLPRHQDQPHHQPPNRAGAPGESLECPAELRPQVPQPPSPAAVPRPPSNPPARGTLKTSNLPEELRKVFITYSMDTAMEVVKFVNFLLVNGFQTAIDIFEDRIRGIDIIKWMERYLRDKTVMIIVAISPKYKQDVEGAESQLDEDEHGLHTKYIHRMMQIEFIKQGSMNFRFIPVLFPNAKKEHVPTWLQNTHVYSWPKNKKNILLRLLREEEYVAPPRGPLPTLQVVPL

SEQ ID NO: 67281 - protein, 574 aa, Homo sapiens
MAPQLEETRMNRSIPVEVDESEPYPSQLLKPIPEYSPEEESEPPAPNIRNMAPNSLSAPTMLHNSSGDFSQAHSTLKLANHQRPVSRQVTCLRTQVLEDSEDSFCRRHPGLGKAFPSGCSAVSEPASESVVGALPAEHQFSFMEKRNQWLVSQLSAASPDTGHDSDKSDQSLPNASADSLGGSQEMVQRPQPHRNRAGLDLPTIDTGYDSQPQDVLGIRQLERPLPLTSVCYPQDLPRPLRSREFPQFEPQRYPACAQMLPPNLSPHAPWNYHYHCPGSPDHQVPYGHDYPRAAYQQVIQPALPGQPLPGASVRGLHPVQKVILNYPSPWDHEERPAQRDCSFPGLPRHQDQPHHQPPNRAGAPGESLECPAELRPQVPQPPSPAAVPRPPSNPPARGTLKTSNLPEELRKVFITYSMDTAMEVVKFVNFLLVNGFQTAIDIFEDRIRGIDIIKWMERYLRDKTVMIIVAISPKYKQDVEGAESQLDEDEHGLHTKYIHRMMQIEFIKQGSMNFRFIPVLFPNAKKEHVPTWLQNTHVYSWPKNKKNILLRLLREEEYVAPPRGPLPTLQVVPL

SEQ ID NO: 67282 - protein, 153 aa, Homo sapiens
MEVVKFVNFLLVNGFQTAIDIFEDRIRGIDIIKWMERYLRDKTVMIIVAISPKYKQDVEGAESQLDEDEHGLHTKYIHRMMQIEFIKQGSMNFRFIPVLFPNAKKEHVPTWLQNTHVYSWPKNKKNILLRLLREEEYVAPPRGPLPTLQVVPL

SEQ ID NO: 67283 - protein, 109 aa, Homo sapiens
MIIVAISPKYKQDVEGAESQLDEDEHGLHTKYIHRMMQIEFIKQGSMNFRFIPVLFPNAKKEHVPTWLQNTHVYSWPKNKKNILLRLLREEEYVAPPRGPLPTLQVVPL

SEQ ID NO: 67284 - protein, 531 aa, Homo sapiens
MISPDPRPSPGLARWAESYEAKCERRQEIRESRRCRPNVTTCRQVGKTLRIQQREQLQRARLQQFFRRRNLELEEKGKAQHPQAREQGPSRRPGQVTGTSSEVFPAQHPPPSGICRDLSDHLSSQAGGLPPQDTPIKKPPKHHRGTQTKAEGPTIKNDASQQTNYGVAVLDKEIIQLSDYLKEALQRELVLKQKMVILQDLLSTLIQASDSSWKGQLNEDKLKGKLRSLENQLYTCTQKYSPWGMKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQQLQAKIECLQGDRDLCSLDTQDLQDQLKRSEAEKLTLVTRVQQLQGLLQNQSLQLQEQEKLLTKKDQALPVWSPKSFPNEVEPEGTGKEKDWDLRDQLQKKTLQLQAKEKECRELHSELDNLSDEYLSCLRKLQHCREELNQSQQLPPRRQCGRWLPVLMVVIAAALAVFLANKDNLMI

SEQ ID NO: 67285 - protein, 182 aa, Homo sapiens
MKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQQLQAKIECLQGDRDLCSLDTQDLQDQLKRSEAEKLTLVTRVQQLQGLLQNQSLQLQEQEKLLTKKGQQIYYHKF

SEQ ID NO: 67286 - protein, 551 aa, Homo sapiens
MISPDPRPSPGLARWAESYEAKCERRQEIRESRRCRPNVTTCRQVGKTLRIQQREQLQRARLQQFFRRRNLELEEKGKAQHPQAREQGPSRRPGQVTVLKEPLSCARRISSPREQVTGTSSEVFPAQHPPPSGICRDLSDHLSSQAGGLPPQDTPIKKPPKHHRGTQTKAEGPTIKNDASQQTNYGVAVLDKEIIQLSDYLKEALQRELVLKQKMVILQDLLSTLIQASDSSWKGQLNEDKLKGKLRSLENQLYTCTQKYSPWGMKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQQLQAKIECLQGDRDLCSLDTQDLQDQLKRSEAEKLTLVTRVQQLQGLLQNQSLQLQEQEKLLTKKDQALPVWSPKSFPNEVEPEGTGKEKDWDLRDQLQKKTLQLQAKEKECRELHSELDNLSDEYLSCLRKLQHCREELNQSQQLPPRRQCGRWLPVLMVVIAAALAVFLANKDNLMI

SEQ ID NO: 67287 - protein, 551 aa, Homo sapiens; identical to SEQ ID NO: 67286

SEQ ID NO: 67288 - protein, 531 aa, Homo sapiens; identical to SEQ ID NO: 67284

SEQ ID NO: 67289 - protein, 404 aa, Homo sapiens
MISPDPRPSPGLARWAESYEAKCERRQEIRESRRCRPNVTTCRQVGKTLRIQQREQLQRARLQQFFRRRNLELEEKGKAQHPQAREQGPSRRPGQVTGTSSEVFPAQHPPPSGICRDLSDHLSSQAGGLPPQDTPIKKPPKHHRGTQTKAEGPTIKNDASQQTNYGVAVLDKEIIQLSDYLKEALQRELVLKQKMVILQDLLSTLIQASDSSWKGQLNEDKLKGKLRSLENQLYTCTQKYSPWGMKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQQLQAKIECLQGDRDLCSLDTQDLQDQLKRSEAEKLTLVTRVQQLQEAAGWTT

SEQ ID NO: 67290 - protein, 320 aa, Homo sapiens
MISPDPRPSPGLARWAESYEAKCERRQEIRESRRCRPNVTTCRQVGKTLRIQQRELEEKGKAQHPQAREQGPSRRPGQVTVLKEPLSCARRISSPREQVTGTSSEVFPAQHPPPSGICRDLSDHLSSQAGGLPPQDTPIKKPPKHHRGTQTKAEGPTIKNDASQQTNYGVAVLDKEIIQLSDYLKEALQRELVLKQKMVILQDLLSTLIQASDSSWKGQLNEDKLKGKLRSLENQLYTCTQKYSPWGMKKVLLEMEDQKNSYEQKAKESLQKVLEEKMNAEQQLQSTQVWGCHIDMGLGTPGSLGNKGSQLHNSLEPSPL

SEQ ID NO: 67291 - protein, 26 aa, Homo sapiens
MISPDPRPSPGLARWAESYEAKCERR

SEQ ID NO: 67292 - protein, 556 aa, Homo sapiens
MQKFIEADYYELDWYYEECSDVLCAERVGQMTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGDHAGPRPLSVLLGDSLWSLIHLRKAGHLCHAYSFFFRDSHPRCWFEFL

SEQ ID NO: 67293 - protein, 145 aa, Homo sapiens
MTVHNLYLFDRNGVCLHYSEWHRKKQAGIPKEEEYKLMYGMLFSIRSFVSKMSPLDMKDGFLAFQTSRYKLHYYETPTGIKVVMNTDLGVGPIRDVLHHIYSALYVELVVKNPLCPLGQTVQSELFRSRLDSYVRSLPFFSARAG

SEQ ID NO: 67294 - protein, 145 aa, Homo sapiens; identical to SEQ ID NO: 67293

SEQ ID NO: 67295 - protein, 1133 aa, Homo sapiens
MSPTQWDFPVELCCRPMAFVTLTGLDVVYNAVHRAVWDAFCANRRADRVPISFKVLPGDHEYPKCRPKRTSYEWYIPKGILKTGWMNKHLNLVPALVVVFYELDWDEPQWKEKQSECATRVEIVRQSLQGRNTKVAVVLIQKKTPLPPGEDVIASERAAALCNACELSGKSLFVLPHTDHLVGYIIRLENAFYEHAQTYYYTEIRRVKSHKEFLNKTTHQLLFVRHQFKIAFFSELKQDTQNALKNYRTAYNLVHELRAHETNILEIKTMAGFINYKICRLCFQHNTPLDAIAQFRKHIDLCKKKIGSAELSFEHDAWMSKQFQAFGDLFDEAIKLGLTAIQTQNPGFYYQQAAYYAQERKQLAKTLCNHEASVMYPNPDPLETQTGVLDFYGQRSWRQGILSFDLSDPEKEKVGILAIQLKERNVVHSEIIITLLSNAVAQFKKYKCPRMKSHLMVQMGEEYYYAKDYTKALKLLDYVMCDYRSEGWWTLLTSVLTTALKCSYLMAQLKDYITYSLELLGRASTLKDDQKSRIEKNLINVLMNESPDPEPDCDILAVKTAQKLWADRISLAGSNIFTIGVQDFVPFVQCKAKFHAPSFHVDVPVQFDIYLKADCPHPIRFSKLCVSFNNQEYNQFCVIEEASKANEVLENLTQGKMCLVPGKTRKLLFKFVAKTEDVGKKIEITSVDLALGNETGRCVVLNWQGGGGDAASSQEALQAARSFKRRPKLPDNEVHWDSIIIQASTMIISRVPNISVHLLHEPPALTNEMYCLVVTVQSHEKTQIRDVKLTAGLKPGQDANLTQKTHVTLHGTELCDESYPALLTDIPVGDLHPGEQLEKMLYVRCGTVGSRMFLVYVSYLINTTVEEKEIVCKCHKDETVTIETVFPFDVAVKFVSTKFEHLERVYADIPFLLMTDLLSASPWALTIVSSELQLAPSMTTVDQLESQVDNVILQTGESASECFCLQCPSLGNIEGGVATGHYIISWKRTSAMENIPIITTVITLPHVIVENIPLHVNADLPSFGRVRESLPVKYHLQNKTDLVQDVEISVEPSDAFMFSGLKQIRLRILPGTEQEMLYNFYPLMAGYQQLPSLNINLLRFPNFTNQLLRRFIPTSIFVKPQGRLMDDTSIAAA

SEQ ID NO: 67296 - protein, 1086 aa, Homo sapiens
MSPTQWDFPVELCCRPMAFVTLTGLDVVYNAVHRAVWDAFCANRRADRVPISFKVLPGDHEYPKCRPKRTSYEWYIPKGILKTGWMNKHLNLVPALVVVFYELDWDEPQWKEKQSECATRVEIVRQSLQGRNTKVAVVLIQKKTPLPPGEDVIASERAAALCNACELSGKSLFVLPHTDHLVGYIIRLENAFYEHAQTYYYTEIRRVKSHKEFLNKTTHQLLFVRHQFKIAFFSELKQDTQNALKNYRTAYNLVHELRAHETNILEIKTMAGFINYKICRLCFQHNTPLDAIAQFRKHIDLCKKKIGSAELSFEHDAWMSKQFQAFGDLFDEAIKLGLTAIQTQNPGFYYQQAAYYAQERKQLAKTLCNHEASVMYPNPDPLETQTGVLDFYGQRSWRQGILSFDLSDPEKEKVGILAIQLKERNVVHSEIIITLLSNAVAQFKKYKCPRMKSHLMVQMGEEYYYAKDYTKALKLLDYVMCDYRSEGWWTLLTSVLTTALKCSYLMAQLKDYITYSLELLGRASTLKDDQKSRIEKNLINVLMNESPDPEPDCDILAVKTAQKLWADRISLAGSNIFTIGVQDFVPFVQCKAKFHAPSFHVDVPVQFDIYLKADCPHPIRFSKLCVSFNNQEYNQFCVIEEASKANEVLENLTQGKMCLVPGKTRKLLFKFVAKTEDVGKKIEITSVDLALGNETGRCVVLNWQGGGGDAASSQEALQAARSFKRRPKLPDNEVHWDSIIIQASTMIISRVPNISVHLLHEPPALTNEMYCLVVTVQSHEKTQIRDVKLTAGLKPGQDANLTQKTHVTLHGTELCDESYPALLTDIPVGDLHPGEQLEKMLYVRCGTVGSRMFLVYVSYLINTTVEEKEIVCKCHKDETVTIETVFPFDVAVKFVSTKFEHLERVYADIPFLLMTDLLSASPWALTIVSSELQLAPSMTTVDQLESQVDNVILQTGESASECFCLQCPSLGNIEGGVATGHYIISWKRTSAMENIPIITTVITLPHVIVENIPLHVNADLPSFGRVRESLPVKYHLQNKTDLVQDVEISVEPSDAFMFSGLKQIRLPAQAFYTYQYFCQATGSTHG

SEQ ID NO: 67297 - protein, 1018 aa, Homo sapiens
MSPTQWDFPVELCCRPMAFVTLTGLDVVYNAVHRAVWDAFCANRRADRVPISFKVLPGDHEYPKCRPKRTSYEWYIPKGILKTGWMNKHLNLVPALVVVFYELDWDEPQWKEKQSECATRVEIVRQSLQGRNTKVAVVLIQKKTPLPPGEDVIASERAAALCNACELSGKSLFVLPHTDHLVGYIIRLENAFYEHAQTYYYTEIRRVKSHKEFLNKTTHQLLFVRHQFKIAFFSELKQDTQNALKNYRTAYNLVHELRAHETNILEIKTMAGFINYKICRLCFQHNTPLDAIAQFRKHIDLCKKKIGSAELSFEHDAWMSKQFQAFGDLFDEAIKLGLTAIQTQNPGFYYQQAAYYAQERKQLAKTLCNHEASVMYPNPDPLETQTGVLDFYGQRSWRQGILSFDLSDPEKEKVGILAIQLKERNVVHSEIIITLLSNAVAQFKKYKCPRMKSHLMVQMGEEYYYAKDYTKALKLLDYVMCDYRSEGWWTLLTSVLTTALKCSYLMAQLKDYITYSLELLGRASTLKDDQKSRIEKNLINVLMNESPDPEPDCDILAVKTAQKLWADRISLAGSNIFTIGVQDFVPFVQCKAKFHAPSFHVDVPVQFDIYLKADCPHPIRFSKLCVSFNNQEYNQFCVIEEASKANEVLENLTQGKMCLVPGKTRKLLFKFVAKTEDVGKKIEITSVDLALGNETGRCVVLNWQGGGGDAASSQEALQAARSFKRRPKLPDNEVHWDSIIIQASTMIISRVPNISVHLLHEPPALTNEMYCLVVTVQSHEKTQIRDVKLTAGLKPGQDANLTQKTHVTLHGTELCDESYPALLTDIPVGDLHPGEQLEKMLYVRCGTVGSRMFLVYVSYLINTTVEEKEIVCKCHKDETVTIETVFPFDVAVKFVSTKFEHLERVYADIPFLLMTDLLSASPWALTIVSSELQLAPSMTTVDQLESQVDNVILQTGESASALYYLLEKDLSNGEYPHHHNCHHSAARDCGEYPSPCECRSAVIWACQRVVTCQVSPTE

SEQ ID NO: 67298 - protein, 696 aa, Homo sapiens
MEDAGGGEEQGLLFQEETIDLGGDEFGSEENETASEGSSPLADKLNEHMMESVLISDSPNSEGDAGDLGRVRDEAEPGGEGDPGPEPAGTPSPSGEADGDCAPEDAAPSSGGAPRQDAAREVPGSEAARPEQEPPVAEPVPVCTIFSQRAPPASGDGFEPQMVKSPSFGGASEASARTPPQVVQPSPSLSTFFGDTAASHSLASDFFDSFTTSAFISVSNPGAGSPAPASPPPLAVPGTEGRPEPVAMRGPQAAAPPASPEPFAHIQAVFAGSDDPFATALSMSEMDRRNDAWLPGEATRGVLRAVATQQRGAVFVDKENLTMPGLRFDNIQGDAVKDLMLRFLGEKAAAKRQVLNADSVEQSFVGLKQLISCRNWRAAVDLCGRLLTAHGQGYGKSGLLTSHTTDSLQLWFVRLALLVKLGLFQNAEMEFEPFGNLDQPDLYYEYYPHVYPGRRGSMVPFSMRILHAELQQYLGNPQESLDRLHKVKTVCSKILANLEQGLAEDGGMSSVTQEGRQGCSYLVASIRLWRSRLGRVMYSMANCLLLMKDYVLAVEAYHSVIKYYPEQEPQLLSGIGRISLQIGDIKTAEKYFQDVEKVTQKLDGLQGKIMVLMNSAFLHLGQNNFAEAHRFFTEILRMDPRNAVQMLSASHPTGKEPSPKDAEEHPEGHRDSAEPGPARPMVPQRAPPGPALCAQP

SEQ ID NO: 67299 - protein, 735 aa, Homo sapiens
MEDAGGGEETPAPEAPHPPQLAPPEEQGLLFQEETIDLGGDEFGSEENETASEGSSPLADKLNEHMMESVLISDSPNSEGDAGDLGRVRDEAEPGGEGDPGPEPAGTPSPSGEADGDCAPEDAAPSSGGAPRQDAAREVPGSEAARPEQEPPVAEPVPVCTIFSQRAPPASGDGFEPQMVKSPSFGGASEASARTPPQVVQPSPSLSTFFGDTAASHSLASDFFDSFTTSAFISVSNPGAGSPAPASPPPLAVPGTEGRPEPVAMRGPQAAAPPASPEPFAHIQAVFAGSDDPFATALSMSEMDRRNDAWLPGEATRGVLRAVATQQRGAVFVDKENLTMPGLRFDNIQGDAVKDLMLRFLGEKAAAKRQVLNADSVEQSFVGLKQLISCRNWRAAVDLCGRLLTAHGQGYGKSGLLTSHTTDSLQLWFVRLALLVKLGLFQNAEMEFEPFGNLDQPDLYYEYYPHVYPGRRGSMVPFSMRILHAELQQYLGNPQESLDRLHKVKTVCSKILANLEQGLAEDGGMSSVTQEGRQASIRLWRSRLGRVMYSMANCLLLMKDYVLAVEAYHSVIKYYPEQEPQLLSGIGRISLQIGDIKTAEKYFQDVEKVTQKLDGLQGKIMVLMNSAFLHLGQNNFAEAHRFFTEILRMDPRNAVANNNAAVCLLYLGKLKDSLRQLEAMVQQDPRHYLHESVLFNLTTMYELESSRSMQKKQALLEAVAGKEGDSFNTQCLKLA

SEQ ID NO: 67300 - protein, 735 aa, Homo sapiens; identical to SEQ ID NO: 67299

SEQ ID NO: 67301 - protein, 140 aa, Homo sapiens [sequence omitted]

SEQ ID NO: 67302 - protein, 140 aa, Homo sapiens [sequence omitted]

SEQ ID NO: 67303 - protein, 140 aa, Homo sapiens [sequence omitted]

SEQ ID NO: 67304 - protein, 140 aa, Homo sapiens [sequence omitted]

SEQ ID NO: 67305 - protein, 147 aa, Homo sapiens
MSGSFYFVIVGHHDNPVFEMEFLPAGKAESKDDHRHLNQFIAHAALDLVDENMWLSNNMYLKTVDKFNEWFVSAFVTAGHILTFLVKMRFIMLHDIRQEDGIKNFFTDVYDLYIKFSMNPFYEPNSPIRSSAFDRKVQFLGKKHLLS

SEQ ID NO: 67306 - protein, 174 aa, Homo sapiens
MSSWKQDRSGLRSTELNVLEYQPLCAVRSHILKTMSGSFYFVIVGHHDNPVFEMEFLPAGKAESKDDHRHLNQFIAHAALDLVDENMWLSNNMYLKTVDKFNEWFVSAFVTAGHMRFIMLHDIRQEDGIKNFFTDVYDLYIKFSMNPFYEPNSPIRSSAFDRKVQFLGKKHLLS

SEQ ID NO: 67307 - protein, 74 aa, Homo sapiens
MSGSFYFVIVGHHDNPVFEMEFLPAGKAESKDDHRHLNQFIAHAALDLVDENMWLSNNMYLKTVDKFNEWFVSA

SEQ ID NO: 67308 - protein, 140 aa, Homo sapiens
MAVCIAVIAKENYPLYIRSTPTENELKFHYMVHTSLDVVDEKISAMGKALVDQRELYLGLLYPTEDYKVYGYVTNSKVKFVMVVDSSNTALRDNEIRSMFRKLHNSYTDVMCNPFYNPGDRIQSSRAFDNMVTSMMIQVC

SEQ ID NO: 67309 - protein, 118 aa, Homo sapiens
MSRQANRGTESKKMSSELFTLTYGALVTQLCKDYENDEDVNKQLDKMGFNIGVRLIEDFLARSNVGRCHDFRETADVIAKERKMFLGKQNKTKRQAKLYDAVKERGAASCTDASPLLS

SEQ ID NO: 67310 - protein, 134 aa, Homo sapiens
MGFNIGVRLIEDFLARSNVGRCHDFRETADVIAKVAFKMYLGITPSITNWSPAGDEFSLILENNPLVDFVELPDNHSSLIYSNLLCGVLRGALEMVQMAVEAKFVQDTLKGDGVTEIRMRFIRRIEDNLPAGEE

SEQ ID NO: 67311 - protein, 134 aa, Homo sapiens; identical to SEQ ID NO: 67310

SEQ ID NO: 67312 - protein, 180 aa, Homo sapiens
MSRQANRGTESKKMSSELFTLTYGALVTQLCKDYENDEDVNKQLDKMGFNIGVRLIEDFLARSNVGRCHDFRETADVIAKVAFKMYLGITPSITNWSPAGDEFSLILENNPLVDFVELPDNHSSLIYSNLLCGVLRGALEMVQMAVEAKFVQDTLKGDGVTEIRMRFIRRIEDNLPAGEE

SEQ ID NO: 67313 - protein, 165 aa, Homo sapiens
MAIFSVYVVNKAGGLIYQLDSYAPRAEAEKTFSYPLDLLLKLHDERVLVAFGQRDGIRVGHAVLAINGMDVNGRYTADGKEMLETDTFKLHCYQTLTGIKFVVLADPRQAGIDSLLRKIYEIYSDFALKNPFYSLEMPIRCELFDQNLKLALEVAEKAGTFGPGS

SEQ ID NO: 67314 - protein, 219 aa, Homo sapiens
MAIFSVYVVNKAGGLIYQLDSYAPRAEAEKTFSYPLDLLLKLHDERVLVAFGQRDGIRVGHAVLAINGMDVNGRYTADGKEVLEYLGNPANYPVSIRFGRPRLTSNEKLMLASMFHSLFAIGSQLSPEQGSSGIEMLETDTFKLHCYQTLTGIKFVVLADPRQAGIDSLLRKIYEIYSDFALKNPFYSLEMPIRCELFDQNLKLALEVAEKAGTFGPGS

SEQ ID NO: 67315 - protein, 1435 aa, Homo sapiens
MAQCVQSVQELIPDSFVPCVAALCSDEAERLTRLNHLSFAELLKPFSRLTSEVHMRDPNNQLHVIKNLKIAVSNIVTQPPQPGAIRKLLNDVVSGSQPAEGLVANVITAGDYDLNISATTPWFESYRETFLQSMPALDHEFLNHYLACMLVASSSEAEPVEQFSKLSQEQHRIQHNSDYSYPKWFIPNTLKYYVLLHDVSAGDEQRAESIYEEMKQKYGTQGCYLLKINSRTSNRASDEQIPDPWSQYLQKNSIQNQESYEDGPCTITSNKNSDNNLLSLDGLDNEVKDGLPNNFRAHPLQLEQSSDPSNSIDGPDHLRSASSLHETKKGNTGIIHGACLTLTDHDRIRQFIQEFTFRGLLPHIEKTIRQLNDQLISRKGLSRSLFSATKKWFSGSKVPEKSINDLKNTSGLLYPPEAPELQIRKMADLCFLVQHYDLAYSCYHTAKKDFLNDQAMLYAAGALEMAAVSAFLQPGAPRPYPAHYMDTAIQTYRDICKNMVLAERCVLLSAELLKSQSKYSEAAALLIRLTSEDSDLRSALLLEQAAHCFINMKSPMVRKYAFHMILAGHRFSKAGQKKHALRCYCQAMQVYKGKGWSLAEDHINFTIGRQSYTLRQLDNAVSAFRHILINESKQSAAQQGAFLREYLYVYKNVSQLSPDGPLPQLPLPYINSSATRVFFGHDRRPADGEKQAATHVSLDQEYDSESSQQWRELEEQVVSVVNKGVIPSNFHPTQYCLNSYSDNSRFPLAVVEEPITVEVAFRNPLKVLLLLTDLSLLWKFHPKDFSGKDNEEVKQLVTSEPEMIGAEVISEFLINGEESKVARLKLFPHHIGELHILGVVYNLGTIQGSMTVDGIGALPGCHTGKYSLSMSVRGKQDLEIQGPRLNNTKEEKTSVKYGPDRRLDPIITEEMPLLEVFFIHFPTGLLCGEIRKAYVEFVNVSKCPLTGLKVVSKRPEFFTFGGNTAVLTPLSPSASENCSAYKTVVTDATSVCTALISSASSVDFGIGTGSQPEVIPVPLPDTVLLPGASVQLPMWLRGPDEEGVHEINFLFYYESVKKQPKIRHRILRHTAIICTSRSLNVRATVCRSNSLENEEGRGGNMLVFVDVENTNTSEAGVKEFHIVQVSSSSKHWKLQKSVNLSENKDTKLASREKGKFCFKAIRCEKEEAATQSSEKYTFADIIFGNEQIISSASPCADFFYRSLSSELKKPQAHLPVHTEKQSTEDAVRLIQKCSEVDLNIVILWKAYVVEDSKQLILEGQHHVILRTIGKEAFSYPQKQEPPEMELLKFFRPENITVSSRPSVEQLSSLIKTSLHYPESFNHPFHQKSLCLVPVTLLLSNCSKADVDVIVDLRHKTTSPEALEIHGSFTWLGQTQYKLQLKSQEIHSLQLKACFVHTGVYNLGTPRVFAKLSDQVTVFETSQQNSMPALIIISNV

SEQ ID NO: 67316 - protein, 1139 aa, Homo sapiens
MSVPDYMQCAEDHQTLLVVVQPVGIVSEENFFRIYKRICSVSQISVRDSQRVLYIRYRHHYPPENNEWGDFQTHRKVVGLITITDCFSAKDWPQTFEKFHVQKEIYGSTLYDSRLFVFGLQGEIVEQPRTDVAFYPNYEDCQTVEKRIEDFIESLFIVLESKRLDRATDKSGDKIPLLCVPFEKKDFVGLDTDSRHYKKRCQGRMRKHVGDLCLQAGMLQDSLVHYHMSVELLRSVNDFLWLGAALEGLCSASVIYHYPGGTGGKSGARRFQGSTLPAEAANRHRPGALTTNGINPDTSTEIGRAKNCLSPEDIIDKYKEAISYYSKYKNAGVIELEACIKAVRVLAIQKRSMEASEFLQNAVYINLRQLSEEEKIQRYSILSELYELIGFHRKSAFFKRVAAMQCVAPSIAEPGWRACYKLLLETLPGYSLSLDPKDFSRGTHRGWAAVQMRLLHELVYASRRMGNPALSVRHLSFLLQTMLDFLSDQEKKDVAQSLENYTSKCPGTMEPIALPGGLTLPPVPFTKLPIVRHVKLLNLPASLRPHKMKSLLGQNVSTKSPFIYSPIIAHNRGEERNKKIDFQWVQGDVCEVQLMVYNPMPFELRVENMGLLTSGVEFESLPAALSLPAESGLYPVTLVGVPQTTGTITVNGYHTTVFGVFSDCLLDNLPGIKTSGSTVEVIPALPRLQISTSLPRSAHSLQPSSGDEISTNVSVQLYNGESQQLIIKLENIGMEPLEKLEVTSKVLTTKEKLYGDFLSWKLEETLAQFPLQPGKVATFTINIKVKLDFSCQENLLQDLSDDGISVSGFPLSSPFRQVVRPRVEGKPVNPPESNKAGDYSHVKTLEAVLNFKYSGGPGHTEGYYRNLSLGLHVEVEPSVFFTRVSTLPATSTRQCHLLLDVFNSTEHELTVSTRSSEALILHAGECQRMAIQVDKFNFESFPESPGEKGQFANPKQLEEERREARGLEIHSKLGICWRIPSLKRSGEASVEGLLNQLVLEHLQLAPLQWDVLVDGQPCDREAVAACQVGDPVRLEVRLTNRSPRSVGPFALTVVPFQDHQNGVHNYDLHDTVSFVGSSTFYLDAVQPSGQSACLGALLFLYTGDFFLHIRFHEDSTSKELPPSWFCLPSVHVCALEAQA

SEQ ID NO: 67317 - protein, 1246 aa, Homo sapiens
MVPAGDQDRAPHRGKPAQAGARTSRASRALRSWRRSQAARATVTHPRGGHDRGSHGGYREGHRGCRRDPQWASAGPPPLSFTEEVKFELRALKDWDFKMSVPDYMQCAEDHQTLLVVVQPVGIVSEENFFRIYKRICSVSQISVRDSQRVLYIRYRHHYPPENNEWGDFQTHRKVVGLITITDCFSAKDWPQTFEKFHVQKEIYGSTLYDSRLFVFGLQGEIVEQPRTDVAFYPNYEDCQTVEKRIEDFIESLFIVLESKRLDRATDKSGDKIPLLCVPFEKKDFVGLDTDSRHYKKRCQGRMRKHVGDLCLQAGMLQDSLVHYHMSVELLRSVNDFLWLGAALEGLCSASVIYHYPGGTGGKSGARRFQGSTLPAEAANRHRPGAQEVLIDPGALTTNGINPDTSTEIGRAKNCLSPEDIIDKYKEAISYYSKYKNAGVIELEACIKAVRVLAIQKRSMEASEFLQNAVYINLRQLSEEEKIQRYSILSELYELIGFHRKSAFFKRVAAMQCVAPSIAEPGWRACYKLLLETLPGYSLSLDPKDFSRGTHRGWAAVQMRLLHELVYASRRMGNPALSVRHLSFLLQTMLDFLSDQEKKDVAQSLENYTSKCPGTMEPIALPGGLTLPPVPFTKLPIVRHVKLLNLPASLRPHKMKSLLGQNVSTKSPFIYSPIIAHNRGEERNKKIDFQWVQGDVCEVQLMVYNPMPFELRVENMGLLTSGVEFESLPAALSLPAESGLYPVTLVGVPQTTGTITVNGYHTTVFGVFSDCLLDNLPGIKTSGSTVEVIPALPRLQISTSLPRSAHSLQPSSGDEISTNVSVQLYNGESQQLIIKLENIGMEPLEKLEVTSKVLTTKEKLYGDFLSWKLEETLAQFPLQPGKVATFTINIKVKLDFSCQENLLQDLSDDGISVSGFPLSSPFRQVVRPRVEGKPVNPPESNKAGDYSHVKTLEAVLNFKYSGGPGHTEGYYRNLSLGLHVEVEPSVFFTRVSTLPATSTRQCHLLLDVFNSTEHELTVSTRSSEALILHAGECQRMAIQVDKFNFESFPESPGEKGQFANPKQLEEERREARGLEIHSKLGICWRIPSLKRSGEASVEGLLNQLVLEHLQLAPLQWDVLVDGQPCDREAVAACQVGDPVRLEVRLTNRSPRSVGPFALTVVPFQDHQNGVHNYDLHDTVSFVGSSTFYLDAVQPSGQSACLGALLFLYTGDFFLHIRFHEDSTSKELPPSWFCLPSVHVCALEAQA

SEQ ID NO: 67318 - protein, 1148 aa, Homo sapiens
MSVPDYMQCAEDHQTLLVVVQPVGIVSEENFFRIYKRICSVSQISVRDSQRVLYIRYRHHYPPENNEWGDFQTHRKVVGLITITDCFSAKDWPQTFEKFHVQKEIYGSTLYDSRLFVFGLQGEIVEQPRTDVAFYPNYEDCQTVEKRIEDFIESLFIVLESKRLDRATDKSGDKIPLLCVPFEKKDFVGLDTDSRHYKKRCQGRMRKHVGDLCLQAGMLQDSLVHYHMSVELLRSVNDFLWLGAALEGLCSASVIYHYPGGTGGKSGARRFQGSTLPAEAANRHRPGAQEVLIDPGALTTNGINPDTSTEIGRAKNCLSPEDIIDKYKEAISYYSKYKNAGVIELEACIKAVRVLAIQKRSMEASEFLQNAVYINLRQLSEEEKIQRYSILSELYELIGFHRKSAFFKRVAAMQCVAPSIAEPGWRACYKLLLETLPGYSLSLDPKDFSRGTHRGWAAVQMRLLHELVYASRRMGNPALSVRHLSFLLQTMLDFLSDQEKKDVAQSLENYTSKCPGTMEPIALPGGLTLPPVPFTKLPIVRHVKLLNLPASLRPHKMKSLLGQNVSTKSPFIYSPIIAHNRGEERNKKIDFQWVQGDVCEVQLMVYNPMPFELRVENMGLLTSGVEFESLPAALSLPAESGLYPVTLVGVPQTTGTITVNGYHTTVFGVFSDCLLDNLPGIKTSGSTVEVIPALPRLQISTSLPRSAHSLQPSSGDEISTNVSVQLYNGESQQLIIKLENIGMEPLEKLEVTSKVLTTKEKLYGDFLSWKLEETLAQFPLQPGKVATFTINIKVKLDFSCQENLLQDLSDDGISVSGFPLSSPFRQVVRPRVEGKPVNPPESNKAGDYSHVKTLEAVLNFKYSGGPGHTEGYYRNLSLGLHVEVEPSVFFTRVSTLPATSTRQCHLLLDVFNSTEHELTVSTRSSEALILHAGECQRMAIQVDKFNFESFPESPGEKGQFANPKQLEEERREARGLEIHSKLGICWRIPSLKRSGEASVEGLLNQLVLEHLQLAPLQWDVLVDGQPCDREAVAACQVGDPVRLEVRLTNRSPRSVGPFALTVVPFQDHQNGVHNYDLHDTVSFVGSSTFYLDAVQPSGQSACLGALLFLYTGDFFLHIRFHEDSTSKELPPSWFCLPSVHVCALEAQA

SEQ ID NO: 67319 - protein, 953 aa, Homo sapiens
MALVFQFGQPVRAQPLPGLCHGKLIRTNACDVCNSTDLPEVEIISLLEEQLPHYKLRADTIYGYDHDDWLHTPLISPDANIDLTTEQIEETLKYFLLCAERVGQMTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTGDHISLPRLATSTPVQHPETSAHHPGKCMSQTNSTFTFTTCRILHPSDELTRVTPSLNSAPTPACGSTSHLKSTPVATPCTPRRLSLAESFTNTRESTTTMSTSLGLVWLLKERGISAAVYDPQSWDRAGRGSLLHSYTPKMAVIPSTPPNSPMQTPTSSPPSFEFKCTSPPYDNFLASKPASSILREVREKNVRSSESQTDVSVSNLNLVDKVRRFGVAKVVNSGRAHVPTLTEEQGPLLCGPPGPAPALVPRGLVPEGLPLRCPTVTSAIGGLQLNSGIRRNRSFPTMVGSSMQMKAPVTLTSGILMGAKLSKQTSLR

SEQ ID NO: 67320 - protein, 686 aa, Homo sapiens
MSLRDKGGEEECFEYDCQDEERKPTHRQHDTQDLLEEVLCAERVGQMTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTGDHISLPRLATSTPVQHPETSGERSQARVTVSGSRSYPSRPQASPEEMQEPPAATEEEEEEEEEEGSGEGTTISPVNLAPFPEAEFWAILTSVPGTIRSGSLSVASARLCG

SEQ ID NO: 67321 - protein, 895 aa, Homo sapiens
MSLRDKGGEEECFEYDCQDEERKPTHRQHDTQDLLEEVLCAERVGQMTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTGDHISLPRLATSTPVQHPETSAHHPGKCMSQTNSTFTFTTCRILHPSDELTRVTPSLNSAPTPACGSTSHLKSTPVATPCTPRRLSLAESFTNTRESTTTMSTSLGLVWLLKERGISAAVYDPQSWDRAGRGSLLHSYTPKMAVIPSTPPNSPMQTPTSSPPSFEFKCTSPPYDNFLASKPASSILREVREKNVRSSESQTDVSVSNLNLVDKVRRFGVAKVVNSGRAHVPTLTEEQGPLLCGPPGPAPALVPRGLVPEGLPLRCPTVTSAIGGLQLNSGIRRNRSFPTMVGSSMQMKAPVTLTSGILMGAKLSKQTSLR

SEQ ID NO: 67322 - protein, 786 aa, Homo sapiens
MALVFQFGQPVRAQPLPGLCHGKLIRTNACDVCNSTDLPEVEIISLLEEQLPHYKLRADTIYGYDHDDWLHTPLISPDANIDLTTEQIEETLKYFLLCAERVGQMTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTAHHPGKCMSQTNSTFTFTTCRILHPSDELTRVTPSLNSAPTPACGSTSHLKSTPVATPCTPRRLSLAESFTNTRESTTTMSTSLGLVWLLKERGISAAVYDPQSWDRAGRGSLLHSHEDVTCANLGEGGVLSSFLLRSTETPKCVLIPWIGNQ

SEQ ID NO: 67323 - protein, 914 aa, Homo sapiens
MSQSQNAIFTSPTGEENLMNSNHRDSESITDVCSNEDLPEVELVSLLEEQLPQYRLKVDTLFLYENQDWTQSPHQRQHASDALSPVLAEETFRYMILGTDRVEQMTKTYNDIDMVTHLLAERDRDLELAARIGQALLKRNHVLSEQNESLEEQLGQAFDQVNQLQHELCKKDELLRIVSIASEESETDSSCSTPLRFNESFSLSQGLLQLEMLQEKLKELEEENMALRSKACHIKTETVTYEEKEQQLVSDCVKELRETNAQMSRMTEELSGKSDELIRYQEELSSLLSQIVDLQHKLKEHVIEKEELKLHLQASKDAQRQLTMELHELQDRNMECLGMLHESQEEIKELRSRSGPTAHLYFSQSYGAFTGESLAAEIEGTMRKKLSLDEESSLFKQKAQQKRVFDTVRIANDTRGRSISFPALLPIPGSNRSSVIMTAKPFESGLQQTEDKSLLNQGSSSEEVAGSSQKMGQPGPSGDSDLATALHRLSLRRQNYLSEKQFFAEEWQRKIQVLADQKEGVSGCVTPTESLASLCTTQSEITDLSSASCLRGFMPEKLQIVKPLEGSQTLYHWQQLAQPNLGTILDPRPGVITKGFTQLPGDAIYHISDLEEDEEEGITFQVQQPLEVEEKLSTSKPVTGIFLPPITSAGGPVTVATANPGKCLSCTNSTFTFTTCRILHPSDITQVTPSSGFPSLSCGSSGSSSSNTAVNSPALSYRLSIGESITNRRDSTTTFSSTMSLAKLLQERGISAKVYHSPISENPLQPLPKSLAIPSTPPNSPSHSPCPSPLPFEPRVHLSENFLASRPAETFLQEMYGLRPSRNPPDVGQLKMNLVDRLKRLGIARVVKNPGAQENGRCQEAEIGPQKPDSAVYLNSGSSLLGGLRRNQSLPVIMGSFAAPVCTSSPKMGVLKED

SEQ ID NO: 67324 - protein, 311 aa, Homo sapiens
MSQSQNAIFTSPTGEENLMNSNHRDSESITDVCSNEDLPEVELVSLLEEQLPQYRLKVDTLFLYENQDWTQSPHQRQHASDALSPVLAEETFRYMILGTDRVEQMTKTYNDIDMVTHLLAERDRDLELAARIGQALLKRNHVLSEQNESLEEQLGQAFDQVNQLQHELCKKDELLRIVSIASEESETDSSCSTPLRFNESFSLSQGLLQLEMLQEKLKELEEENMALRSKACHIKTETVTYEEKEQQLVSDCVKELRETNAQMSRMTEELSGKSDELIRYQEELSSLLSQIVDLQHKLKEVGLFIHSTDIC

SEQ ID NO: 67325 - protein, 30 aa, Homo sapiens
MSQSQNAIFTSPTGEENLMNSNHRDSESIT

SEQ ID NO: 67326 - protein, 779 aa, Homo sapiens
MILGTDRVEQMTKTYNDIDMVTHLLAERDRDLELAARIGQALLKRNHVLSEQNESLEEQLGQAFDQVNQLQHELCKKDELLRIVSIASEESETDSSCSTPLRFNESFSLSQGLLQLEMLQEKLKELEEENMALRSKACHIKTETVTYEEKEQQLVSDCVKELRETNAQMSRMTEELSGKSDELIRYQEELSSLLSQIVDLQHKLKEHVIEKEELKLHLQASKDAQRQLTMELHELQDRNMECLGMLHESQEEIKELRSRSGPTAHLYFSQSYGAFTGESLAAEIEGTMRKKLSLDEESSLFKQKAQQKRVFDTVRIANDTRGRSISFPALLPIPGSNRSSVIMTAKPFESGLQQTEDKSLLNQGSSSEEVAGSSQKMGQPGPSGDSDLATALHRLSLRRQNYLSEKQFFAEEWQRKIQVLADQKEGVSGCVTPTESLASLCTTQSEITDLSSASCLRGFMPEKLQIVKPLEGSQTLYHWQQLAQPNLGTILDPRPGVITKGFTQLPGDAIYHISDLEEDEEEGITFQVQQPLEVEEKLSTSKPVTGIFLPPITSAGGPVTVATANPGKCLSCTNSTFTFTTCRILHPSDITQVTPSSGFPSLSCGSSGSSSSNTAVNSPALSYRLSIGESITNRRDSTTTFSSTMSLAKLLQERGISAKVYHSPISENPLQPLPKSLAIPSTPPNSPSHSPCPSPLPFEPRVHLSENFLASRPAETFLQEMYGLRPSRNPPDVGQLKMNLVDRLKRLGIARVVKNPVPKRMEDARRQKLVLKNQILLFI

SEQ ID NO: 67327 - protein, 161 aa, Homo sapiens
MEKPLTVLRVSLYHPTLGPSAFANVPPRLQHDTSPLLLGRGQDAHLQLQLPRLSRRHLSLEPYLEKGSALLAFCLKALSRKGCVWVNGLTLRYLEQVPLSTVNRVSFSGIQMLVRVEEGTSLEAFVCYFHVSPSPLIYRPEAEETDEWEGISQGQPPPGSG

SEQ ID NO: 67328 - protein, 582 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIKGAADEIMLPCEFCEELYPEELLIDHQTSCNPSRALPSLNTGSSSPRGVEEPDVIFQNFLQQAASNQLDSLMGLSNSHPVEESIIIPCEFCGVQLEEEVLFHHQDQCDQRPATATNHVTEGIPRLDSQPQETSPELPRRRVRHQGDLSSGYLDDTKQETANGPTSCLPPSRPINNMTATYNQLSRSTSGPRPGCQPSSPCVPKLSNSDSQDIQGRNRDSQNGAIAPGHVSVIRPPQNLYPENIVPSFSPGPSGRYGASGRSEGGRNSRVTPAAANYRSRTAKAKPSKQQGAGDAEEEEEE

SEQ ID NO: 67329 - protein, 582 aa, Homo sapiens; identical to SEQ ID NO: 67328

SEQ ID NO: 67330 - protein, 135 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVC

SEQ ID NO: 67331 - protein, 164 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPELKNKRGRKGIEANSPPKRVVKRVQTWTSCWP

SEQ ID NO: 67332 - protein, 283 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIK

SEQ ID NO: 67333 - protein, 308 aa, Homo sapiens [sequence omitted]

SEQ ID NO: 67334 - protein, 323 aa, Homo sapiens
MILQETKAACGIPAIPHCSRVEILDAKTREKLCFLDKVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKNCTYYWGFAAWMAYYINHPLYTPPTYGAQQVKLALAIFVICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 67335 - protein, 337 aa, Homo sapiens
MSSSPVKRQRMESALDQLKQFTTVVADTGDFHAIDEYKPQDATTNPSLILAAAQMPAYQELVEEAIAYGRKLGGSQEDQIKNAIDKLFVLFGAEILKKIPGRVSTEVDARLSFDKDAMVARARRLIELYKEAGISKDRILIKLSSTWEGIQAGKELEEQHGIHCNMTLLFSFAQAVACAEAGVTLISPFVGRILDWHVANTDKKSYEPLEDPGVKSVTKIYNYYKKFSYKTIVMGASFRNTGEIKALAGCDFLTISPKLLGELLQDNAKLVPVLSAKAAQASDLEKIHLDEKSFRWLHNEDQMAVEKLSDGIRKFAADAVKLERMLTERMFNAENGK

SEQ ID NO: 67336 - protein, 318 aa, Homo sapiens
MSSSPVKRQRMESALDQLKQFTTVVADTGDFHAIDEYKPQDATTNPSLILAAAQMPAYQELVEEAIAYGRKLGGSQEDQIKNAIDKLFVLFGAEILKKIPGRVSTEVDARLSFDKDAMVARARRLIELYKEAGISKDRILIKLSSTWEGIQAGKELEEQHGIHCNMTLLFSFAQAVACAEAGVTLISPFVGRILDWHVANTDKKSYEPLEDPGVKSVTKIYNYYKKFSYKTIVMGASFRNTGEIKALAGCDFLTISPKLLGELLQDNAKLVPVLSAKPKPVTWKKSTWMRSLSVGCTTRTRWLWRSSLTGSASLPLMQ

SEQ ID NO: 67337 - protein, 433 aa, Homo sapiens
MRQSHQLPLVGLLLFSFIPSQLCEICEVSEENYIRLKPLLNTMIQSNYNRGTSAVNVVLSLKLVGIQIQTLMQKMIQQIKYNVKSRLSDVSSGELALIILALGVCRNAEENLIYDYHLIDKLENKFQAEIENMEAHNGTPLTNYYQLSLDVLALCLFNGNYSTAEVVNHFTPENKNYYFGSQFSVDTGAMAVLALTCVKKSLINGQIKADEGSLKNISIYTKSLVEKILSEKKENGLIGNTFSTGEAMQALFVSSDYYNENDWNCQQTLNTVLTEISQGAFSNPNAAAQVLPALMGKTFLDINKDSSCVSASGNFNISADEPITVTPPDSQSYISVNYSVRINETYFTNVTVLNGSVFLSVMEKAQKMNDTIFGFTMEERSWGPYITCIQGLCANNNDRTYWELLSGGEPLSQGAGSYVVRNGENLEVRWSKY

SEQ ID NO: 67338 - protein, 427 aa, Homo sapiens
MRHLGAFLFLLGVLGALTEMCEIPEMDSHLVEKLGQHLLPWMDRLSLEHLNPSIYVGLRLSSLQAGTKEDLYLHSLKLGYQQCLLGSAFSEDDGDCQGKPSMGQLALYLLALRANCEFVRGHKGDRLVSQLKWFLEDEKRAIGHDHKGHPHTSYYQYGLGILALCLHQKRVHDSVVDKLLYAVEPFHQGHHSVDTAAMAGLAFTCLKRSNFNPGRRQRITMAIRTVREEILKAQTPEGHFGNVYSTPLALQFLMTSPMRGAELGTACLKARVALLASLQDGAFQNALMISQLLPVLNHKTYIDLIFPDCLAPRVMLEPAAETIPQTQEIISVTLQVLSLLPPYRQSISVLAGSTVEDVLKKAHELGGFTYETQASLSGPYLTSVMGKAAGEREFWQLLRDPNTPLLQGIADYRPKDGETIELRLVSW

SEQ ID NO: 67339 - protein, 400 aa, Homo sapiens
MRHLGAFLFLLGVLGALTEMCEIPEMDSHLVEKLGQHLLPWMDRLSLEHLNPSIYVGLRLSSLQAGTKEDLYLHSLKLGYQQCLLGSAFSEDDGDCQGKPSMGQLALYLLALRANWHDHKGHPHTSYYQYGLGILALCLHQKRVHDSVVDKLLYAVEPFHQGHHSVDTAAMAGLAFTCLKRSNFNPGRRQRITMAIRTVREEILKAQTPEGHFGNVYSTPLALQFLMTSPMRGAELGTACLKARVALLASLQDGAFQNALMISQLLPVLNHKTYIDLIFPDCLAPRVMLEPAAETIPQTQEIISVTLQVLSLLPPYRQSISVLAGSTVEDVLKKAHELGGFTYETQASLSGPYLTSVMGKAAGEREFWQLLRDPNTPLLQGIADYRPKDGETIELRLVSW

SEQ ID NO: 67340 - protein, 280 aa, Homo sapiens
MEDEVVRFAKKMDKMVQKKNASTRIGMSVNAIRKQSTDEEVTSLAKSLIKSWKKLLDGPSTEKDLDEKKKEPAITSQNSPEAREESTSSGNVSNRKDETNARDTYVSSFPRAPSTSDSVRLKCREMLAAALRTGDDYIAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 67341 - protein, 301 aa, Homo sapiens
MEDEVVRFAKKMDKMVQKKNAAGALDLLKELKNIPMTLELLQSTRIGMSVNAIRKQSTDEEVTSLAKSLIKSWKKLLDGPSTEKDLDEKKKEPAITSQNSPEAREESTSSGNVSNRKDETNARDTYVSSFPRAPSTSDSVRLKCREMLAAALRTGDDYIAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 67342 - protein, 117 aa, Homo sapiens
MEDEVVRFAKKMDKMVQKKNAAGALDLLKELKNIPMTLELLQEMASDELKEMRKNLTKEAIREHQMAKTGGTQTDLFTCGKCKKKNCTYTQVQTRSADEPMTTFVVCNECGNRWKFC

SEQ ID NO: 67343 - protein, 159 aa, Homo sapiens
MDKPRKENEEEPQSAPKTDEERPPVEHSPEKQSPEEQSSEEQSSEEEFFPEELLPELLPEMLLSEERPPQEGLSRKDLFEGRPPMEQPPCGVGKHKLEEGSFKERLARSRPQFRGDIHGRNLSNEEMIQAADELEEMKRVRNKLMIMHWKAKRSRPYPI

SEQ ID NO: 67344 - protein, 159 aa, Homo sapiens; identical to SEQ ID NO: 67343

SEQ ID NO: 67345 - protein, 159 aa, Homo sapiens; identical to SEQ ID NO: 67343

SEQ ID NO: 67346 - protein, 156 aa, Homo sapiens
MDKPRKENEEEPQRPRPMRRGLRWSTLPKSSPPRSSLRRSSPRRRSSFLRSSCLSSCLRCSSRRSPQEGLSRKDLFEGRPPMEQPPCGVGKHKLEEGSFKERLARSRPQFRGDIHGRNLSNEEMIQAADELEEMKRVRNKLMIMHWKAKRSRPYPI

SEQ ID NO: 67347 - protein, 100 aa, Homo sapiens
MQKPCKENEGKPKCSVPKREEKRPYGEFERQQTEGNFRQRLLQSLEEFKEDIDYRHFKDEEMTREGDEMERCLEEIRGLRKKFRALHSNHRHSRDRPYPI

SEQ ID NO: 67348 - protein, 100 aa, Homo sapiens; identical to SEQ ID NO: 67347

SEQ ID NO: 67349 - protein, 96 aa, Homo sapiens
MYVKLISSDGHEFIVKREHALTSGTIKAMLSGPGQFAENETNEVNFREIPSHVLSKVCMYFTYKVRYTNSSTEIPEFPIAPEIALELLMAANFLDC

SEQ ID NO: 67350 - protein, 112 aa, Homo sapiens
MDGEEKTYGGCEGPDAMYVKLISSDGHEFIVKREHALTSGTIKAMLSGPGQFAENETNEVNFREIPSHVLSKVCMYFTYKVRYTNSSTEIPEFPIAPEIALELLMAANFLDC

SEQ ID NO: 67351 - protein, 112 aa, Homo sapiens; identical to SEQ ID NO: 67350

SEQ ID NO: 67352 - protein, 112 aa, Homo sapiens; identical to SEQ ID NO: 67350

SEQ ID NO: 67353 - protein, 112 aa, Homo sapiens; identical to SEQ ID NO: 67350

SEQ ID NO: 67354 - protein, 112 aa, Homo sapiens; identical to SEQ ID NO: 67350

SEQ ID NO: 67355 - protein, 112 aa, Homo sapiens; identical to SEQ ID NO: 67350

SEQ ID NO: 67356 - protein, 798 aa, Homo sapiens
MHGGRSCGPRTRREPSSGEEAAPVTAMAAESALQVVEKLQARLAANPDPKKLLKYLKKLSTLPITVDILAETGVGKTVNSLRKHEHVGSFARDLVAQWKKLVPVERNAEPDEQDFEKSNSRKRPRDALQKEEEMEGDYQETWKATGSRSYSPDHRQKKHRKLSELERPHKVSHGHERRDERKRCHRMSPTYSSDPESSDYGHVQSPPSCTSPHQMYVDHYRSLEEDQEPIVSHQKPGKGHSNAFQDRLGASQERHLGEPHGKGVVSQNKEHKSSHKDKRPVDAKSDEKASVVSREKSHKALSKEENRRPPSGDNAREKPPSSGVKKEKDREGSSLKKKCLPPSEAASDNHLKKPKHRDPEKAKLDKSKQGLDSFDTGKGAGDLLPKVKEKGSNNLKTPEGKVKTNLDRKSLGSLPKVEETDMEDEFEQPTMSFESYLSYDQPRKKKKKIVKTSATALGDKGLKKNDSKSTGKNLDSVQKLPKVNKTKSEKPAGADLAKLRKVPDVLPVLPDLPLPAIQANYRPLPSLELISSFQPKRKAFSSPQEEEEAGFTGRRMNSKMQVYSGSKCAYLPKMMTLHQQCIRVLKNNIDSIFEVGGVPYSVLEPVLERCTPDQLYRIEEYNHVLIEETDQLWKVHCHRDFKEERPEEYESWREMYLRLQDAREQRLRVLTKNIQFAHANKPKGRQAKMAFVNSVAKPPRDVRRRQEKFGTGGAAVPEKIKIKPAPYPMGSSHASASSISFNPSPEEPAYDGPSTSSAHLAPVVSSTVSYDPRKPTVKKIAPMMAKTIKAFKNRFSRR

SEQ ID NO: 67357 - protein, 1098 aa, Homo sapiens
MAERGGDGGESERFNPGELRMAQQQALRFRGPAPPPNAVMRGPPPLMRPPPPFGMMRGPPPPPRPPFGRPPFDPNMPPMPPPGGIPPPMGPPHLQRPPFMPPPMSSMPPPPGMMFPPGMPPVTAPGTPALPPTEEIWVENKTPDGKVYYYNARTRESAWTKPDGVKVIQQSELTPMLAAQAQVQAQAQAQAQAQAQAQAQAQAQAQAQAQAQAQAQAQAQAQAQAQAQAQAQAQAQAQAQAQVQAQVQAQVQAQAVGASTPTTSSPAPAVSTSTSSSTPSSTTSTTTTATSVAQTVSTPTTQDQTPSSAVSVATPTVSVSTPAPTATPVQTVPQPHPQTLPPAVPHSVPQPTTAIPAFPPVMVPPFRVPLPGMPIPLPGVAMMQIVSCPYVKTVATTKTGVLPGMAPPIVPMIHPQVAIAASPATLAGATAVSEWTEYKTADGKTYYYNNRTLESTWEKPQELKEKEKLEEKIKEPIKEPSEEPLPMETEEEDPKEEPIKEIKEEPKEEEMTEEEKAAQKAKPVATAPIPGTPWCVVWTGDERVFFYNPTTRLSMWDRPDDLIGRADVDKIIQEPPHKKGMEELKKLRHPTPTMLSIQKWQFSMSAIKEEQELMEEINEDEPVKAKKRKRDDNKDIDSEKEAAMEAEIKAARERAIVPLEARMKQFKDMLLERGVSAFSTWEKELHKIVFDPRYLLLNPKERKQVFDQYVKTRAEEERREKKNKIMQAKEDFKKMMEEAKFNPRATFSEFAAKHAKDSRFKAIEKMKDREALFNEFVAAARKKEKEDSKTRGEKIKSDFFELLSNHHLDSQSRWSKVKDKVESDPRYKAVDSSSMREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAITLTSTWKEVKKIIKEDPRCIKFSSSDRKKQREFEEYIRDKYITAKADFRTLLKETKFITYRSKKLIQESDQHLKDVEKILQNDKRYLVLDCVPEERRKLIVAYVDDLDRRGPPPPPTASEPTRRSTK

SEQ ID NO: 67358 - protein, 1077 aa, Homo sapiens
MAERGGDGGESERFNPGELRMAQQQALRFRGPAPPPNAVMRGPPPLMRPPPPFGMMRGPPPPPRPPFGRPPFDPNMPPMPPPGGIPPPMGPPHLQRPPFMPPPMSSMPPPPGMMFPPGMPPVTAPGTPALPPTEEIWVENKTPDGKVYYYNARTRESAWTKPDGVKVIQQSELTPMLAAQAQVQAQAQAQAQAQAQAQAQAQAQAQAQAQAQAQAQAQAQAQAQAQAQAQAQAQAQAQAQAQVQAQVQAQVQAQAVGASTPTTSSPAPAVSTSTSSSTPSSTTSTTTTATSVAQTVSTPTTQDQTPSSAVSVATPTVSVSTPAPTATPVQTVPQPHPQTLPPAVPHSVPQPTTAIPAFPPVMVPPFRVPLPGMPIPLPGVLPGMAPPIVPMIHPQVAIAASPATLAGATAVSEWTEYKTADGKTYYYNNRTLESTWEKPQELKEKEKLEEKIKEPIKEPSEEPLPMETEEEDPKEEPIKEIKEEPKEEEMTEEEKAAQKAKPVATAPIPGTPWCVVWTGDERVFFYNPTTRLSMWDRPDDLIGRADVDKIIQEPPHKKGMEELKKLRHPTPTMLSIQKWQFSMSAIKEEQELMEEINEDEPVKAKKRKRDDNKDIDSEKEAAMEAEIKAARERAIVPLEARMKQFKDMLLERGVSAFSTWEKELHKIVFDPRYLLLNPKERKQVFDQYVKTRAEEERREKKNKIMQAKEDFKKMMEEAKFNPRATFSEFAAKHAKDSRFKAIEKMKDREALFNEFVAAARKKEKEDSKTRGEKIKSDFFELLSNHHLDSQSRWSKVKDKVESDPRYKAVDSSSMREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAITLTSTWKEVKKIIKEDPRCIKFSSSDRKKQREFEEYIRDKYITAKADFRTLLKETKFITYRSKKLIQESDQHLKDVEKILQNDKRYLVLDCVPEERRKLIVAYVDDLDRRGPPPPPTASEPTRRSTK

SEQ ID NO: 67359 - protein, 682 aa, Homo sapiens
MNPQQQRMAAIGTDKELSDLLDFSAMFSPPVNSGKTRPTTLGSSQFSGSGIDERGGTTSWGTSGQPSPSYDSSRGFTDSPHYSDHLNDSRLGAHEGLSPTPFMNSNLMGKTSERGSFSLYSRDTGLPGCQSSLLRQDLGLGSPAQLSSSGKPGTAYYSFSATSSRRRPLHDSAALDPLQAKKVRKVPPGLPSSVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 67360 - protein, 706 aa, Homo sapiens
MNPQQQRMAAIGTDKELSDLLDFSAMFSPPVNSGKTRPTTLGSSQFSGSGIDERGGTTSWGTSGQPSPSYDSSRGFTDSPHYSDHLNDSRLGAHEGLSPTPFMNSNLMGKTSERGSFSLYSRDTGLPGCQSSLLRQDLGLGSPAQLSSSGKPGTAYYSFSATSSRRRPLHDSAALDPLQAKKVRKVPPGLPSSVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLKNRVEQQLHEHLQDAMSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 67361 - protein, 702 aa, Homo sapiens
MNPQQQRMAAIGTDKELSDLLDFSAMFSPPVNSGKTRPTTLGSSQFSGSGTIHEMKQLNSKARQKGQRIKGFTDSPHYSDHLNDSRLGAHEGLSPTPFMNSNLMGKTSERGSFSLYSRDTGLPGCQSSLLRQDLGLGSPAQLSSSGKPGTAYYSFSATSSRRRPLHDSAALDPLQAKKVRKVPPGLPSSVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLKNRVEQQLHEHLQDAMSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 67362 - protein, 446 aa, Homo sapiens
MGKRYMHHPQIQMISTVNLLVIHLLSHQPVCSLALSLCKSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 67363 - protein, 681 aa, Homo sapiens
MAAFSVLRPRVPGSSGTWAADPDASTAVSPSLRFGGREPARPTRGGATKWPKMNPQQQRMAAIGTDKELSDLLDFSAMFSPPVNSGKTRPTTLGSSQFSGSGIDERGGTTSWGTSGQPSPSYDSSRGFTDSPHYSDHLNDSRLGAHEGLSPTPFMNSNLMGKTSERGSFSLYSRDTGLPGCQSSLLRQDLGLGSPAQLSSSGKPGTAYYSFSATSSRRRPLHDSAALDPLQAKKVRKVPPGLPSSVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVTTIGP

SEQ ID NO: 67364 - protein, 294 aa, Homo sapiens
MSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 67365 - protein, 536 aa, Homo sapiens
MYCAYPVPGMGSNSLMYYYNGKTVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLKNRVEQQLHEHLQDAMSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 67366 - protein, 682 aa, Homo sapiens; identical to SEQ ID NO: 67359

SEQ ID NO: 67367 - protein, 339 aa, Homo sapiens
MSSNSSTSQWPRPGGQAPSSPSYENSLHSLKNRVEQQLHEHLQDAMSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 67368 - protein, 446 aa, Homo sapiens; identical to SEQ ID NO: 67362

SEQ ID NO: 67369 - protein, 512 aa, Homo sapiens
MYCAYPVPGMGSNSLMYYYNGKTVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 67370 - protein, 199 aa, Homo sapiens
MAFALLRPVGAHVLYPDVRLLSEDEENRSESDASDQSFGCCEGPEAARRGPGPGGGRRAGGGGGAGPVVVVRQRQAANARERDRTQSVNTAFTALRTLIPTEPVDRKLSKIETVRLASSYIAHLANVLLLGDSADDGQPCFRAAGSAKGAVPAAADGGRQPRSICTFCLSNQRKGGGRRDLGGSCLKVRGVAPLRGPRR

SEQ ID NO: 67371 - protein, 345 aa, Homo sapiens
MLPCFQLLRIGGGRGGDLYTFHPPAGAGCTYRLGHRADLCDVALRPQQEPGLISGIHAELHAEPRGDDWRVSLEDHSSQGTLVNNVRLPRGHRLELSDGDLLTFGPEGPPGTSPSEFYFMFQQVRVKPQDFAAITIPRSRGEARVGAGFRPMLPSQGAPQRPLSTFSPAPKATLILNSIGSLSKLRPQPLTFSPSWGGPKSLPVPAPPGEMGTTPSAPPQRNRRKSVHRVLAELDDESEPPENPPPVLMEPRKKLRVDKAPLTPTGNRRGRPRKYPVSAPMAPPAVGGGEPCAAPCCCLPQEETVAWVQCDGCDVWFHVACVGCSIQAAREADFRCPGCRAGIQT

SEQ ID NO: 67372 - protein, 345 aa, Homo sapiens; identical to SEQ ID NO: 67371

SEQ ID NO: 67373 - protein, 345 aa, Homo sapiens
MLPCFQLLRIGGGRGGDLYTFHPPAGAGCTYRLGHRADLCDVALRPQQEPGLISGIHAELHAEPRGDDWRVSLEDHSSQGTLVNNVRLPRGHRLELSDGDLLTFGPEGPPGTSPSEFYFMFQQVRVKPQDFAAITIPRSRGEARVGAGFRPMLPSQGAPQRPLSTFSPAPKATLILNSIGSLSKLRPQPLTFSPSWGGPKSLPVPAPPGEVGTTPSAPPQRNRRKSVHRVLAELDDESEPPENPPPVLMEPRKKLRVDKAPLTPTGNRRGRPRKYPVSAPMAPPAVGGGEPCAAPCCCLPQEETVAWVQCDGCDVWFHVACVGCSIQAAREADFRCPGCRAGIQT

SEQ ID NO: 67374 - protein, 345 aa, Homo sapiens; identical to SEQ ID NO: 67373

SEQ ID NO: 67375 - protein, 345 aa, Homo sapiens; identical to SEQ ID NO: 67373

SEQ ID NO: 67376 - protein, 345 aa, Homo sapiens; identical to SEQ ID NO: 67373

SEQ ID NO: 67377 - protein, 345 aa, Homo sapiens; identical to SEQ ID NO: 67373

SEQ ID NO: 67378 - protein, 345 aa, Homo sapiens
MLPCFQLLRIGGGRGGDLYTFHPPAGAGCTYRLGHRADLCDVALRPQQEPGLISGIHAELHAEPRGDDWRVSLEDHSSQGTLVNNVRLPRGHRLELSDGDLLTFGPEGSPGTSPSEFYFMFQQVRVKPQDFAAITIPRSRGEARVGAGFRPMLPSQGAPQRPLSTFSPAPKATLILNSIGSLSKLRPQPLTFSPSWGGPKSLPVPAPPGEVGTTPSAPPQRNRRKSVHRVLAELDDESEPPENPPPVLMEPRKKLRVDKAPLTPTGNRRGRPRKYPVSAPMAPPAVGGGEPCAAPCCCLPQEETVAWVQCDGCDVWFHVACVGCSIQAAREADFRCPGCRAGIQT

SEQ ID NO: 67379 - protein, 345 aa, Homo sapiens; identical to SEQ ID NO: 67373

SEQ ID NO: 67380 - protein, 345 aa, Homo sapiens; identical to SEQ ID NO: 67373

SEQ ID NO: 67381 - protein, 345 aa, Homo sapiens; identical to SEQ ID NO: 67373

SEQ ID NO: 67382 - protein, 345 aa, Homo sapiens; identical to SEQ ID NO: 67373

SEQ ID NO: 67383 - protein, 345 aa, Homo sapiens; identical to SEQ ID NO: 67373

SEQ ID NO: 67384 - protein, 345 aa, Homo sapiens; identical to SEQ ID NO: 67378

SEQ ID NO: 67385 - protein, 217 aa, Homo sapiens
TLVNNVRLPRGHRLELSDGDLLTFGPEGPPGTSPSEFYFMFQQVRVKPQDFAAITIPRSRGEARVGAGFRPMLPSQGAPQRPLSTFSPAPKATLILNSIGSLSKLRPQPLTFSPSWGGPKSLPVPAPPGEMGTTPSAPPQRNRRKSVHRVLAELDDESEPPENPPPVLMEPRKKLRVDKAPLTPTGNWHIQGMQSIVKGQKERPWPREHLSGYEEAS

SEQ ID NO: 67386 - protein, 214 aa, Homo sapiens
MSQRKARGPPAMPGVGHSQTQAKARLLPGADRKRSRLSRTRQDPWEERSWSNQRWSRATPGPRGTRAGGLALGRSEASPENAARERSRVRTLRQAFLALQAALPAVPPDTKLSKLDVLVLAASYIAHLTRTLGHELPGPAWPPFLRGLRYLHPLKKWPMRSRLYAGGLGYSDLDSTTASTPSQRTRDAEVGSQVPGEADALLSTTPLSPALGDK

SEQ ID NO: 67387 - protein, 676 aa, Homo sapiens
MSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 67388 - protein, 473 aa, Homo sapiens
MRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERKGEEERNSVIWGSQLCVCRPRSFPSPPNVQALACRPLWQAKSYQPWKHHCSLLPVTVAKLYHGGGEARGRSGWGSEPQPGPEQADAGCARHDGQLPPQRPGGAARGRR

SEQ ID NO: 67389 - protein, 216 aa, Homo sapiens
MSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRDRVLLGCPVWF

SEQ ID NO: 67390 - protein, 207 aa, Homo sapiens
LTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNDLSAPKKCRARFGLDQQNNWCGPCRRKKKCVRYIQGEGSCLSPPSSDGSLL

SEQ ID NO: 67391 - protein, 222 aa, Homo sapiens
TNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSPLPCCTQGHDCQHFYPPSDFTVSTQVFRDMKRSHSLQKVGEPWCIESNKVPVVQHPHHVHPLTPLITYSNEHFTPGNPPPHLPADVDPKT

SEQ ID NO: 67392 - protein, 288 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWQGQPVYPITTGGFRHPYPTALTVNASMSR

SEQ ID NO: 67393 - protein, 459 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCSL

SEQ ID NO: 67394 - protein, 489 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVSPLPCCTQGHDCQHFYPPSDFTVSTQVFRDMKRSHSLQKVGEPWCIESNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNGEKKSAFATYKVKAAASAHPLQMEAY

SEQ ID NO: 67395 - protein, 619 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 67396 - protein, 120 aa, Homo sapiens
MLYMKEMRAKVVAECTLKESAAINQILGRRWHALSREEQAKYYELARKERQLHMQLYPGWSARDNYGKKKKRKRDKQPGETNDLSAPKKCRARFGLDQQNNWCGPCRCKYSKEVSGTVRA

SEQ ID NO: 67397 - protein, 176 aa, Homo sapiens
MSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNGEKKSAFATYKVKAAASAHPLQMEAY

SEQ ID NO: 67398 - protein, 317 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVQSPLPCCTQGHDCQHFYPPSDFTVSTQVFRDMKRSHSLQKVGEPWCIESNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSR

SEQ ID NO: 67399 - protein, 596 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 67400 - protein, 494 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCRCKYSKEVSGTVRA

SEQ ID NO: 67401 - protein, 602 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNDLSAPKKCRARFGLDQQNNWCGPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 67402 - protein, 482 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITGEKKSAFATYKVKAAASAHPLQMEAY

SEQ ID NO: 67403 - protein, 335 aa, Homo sapiens
MSSFLSSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 67404 - protein, 602 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNDANTPKKCRALFGLDRQTLWCKPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 67405 - protein, 619 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDANTPKKCRALFGLDRQTLWCKPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 67406 - protein, 214 aa, Homo sapiens
MAFLRSMWGVLSALGRSGAELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKEKLKTVKENWKNLSDSEKELYIQHAKEDETRYHNEMKSWEEQMIEVGRKDLLRRTIKKQRKYGAEEC

SEQ ID NO: 67407 - protein, 219 aa, Homo sapiens
  MOD_RES (1)..(1): Any amino acid
XELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQEKLKTVKENWKNLSDSEKEVSITVVSLKCLLRISVRECIRARLDSCEDNLVLLIIQVF

SEQ ID NO: 67408 - protein, 246 aa, Homo sapiens
MAFLRSMWGVLSALGRSGAELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQEKLKTVKENWKNLSDSEKELYIQHAKEDETRYHNEMKSWEEQMIEVGRKDLLRRTIKKQRKYGAEEC

SEQ ID NO: 67409 - protein, 433 aa, Homo sapiens
MSILAKMGDWQDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 67410 - protein, 437 aa, Homo sapiens
MLWKLTDNIKYEDCEDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 67411 - protein, 431 aa, Homo sapiens
MLVHSFSAMDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 67412 - protein, 439 aa, Homo sapiens
MKMLWKLTDNIKYEDCEDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 67413 - protein, 328 aa, Homo sapiens
MLWKLTDNIKYEDCEDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEDRYAKSSPTCWLRTDLPWGTHGPTPSWSPASRAA

SEQ ID NO: 67414 - protein, 437 aa, Homo sapiens; identical to SEQ ID NO: 67410

SEQ ID NO: 67415 - protein, 469 aa, Homo sapiens
MHSPPRDQAAIMLWKLVENVKYEDIYEMLVHTYSSMDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKKVPVPPKSVTSLMMNKDGFLGGMSVNTGEVFCSVPGRLSLLSSTSKYKVTVGEVQRRLSPPECLNASLLGGVLRRAKSKNGGRSLRERLEKIGLNLPAGRRKAANVTLLTSLVEGEAVHLARDFGYICETEFPAKAVSEYLNRQHTDPSDLHSRKNMLLATKQLCKEFTDLLAQDRTPIGNSRPSPILEPGIQSCLTHFSLITHGFGAPAICAALTALQNYLTEALKGMDKMFLNNTTTNRHTSGEGPGSKTGDKEEKHRK

SEQ ID NO: 67416 - protein, 198 aa, Homo sapiens
MLWKLVENVKYEDIYEMLVHTYSSMDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKK

SEQ ID NO: 67417 - protein, 460 aa, Homo sapiens
MHSPPRDQAAIMLWKLVENVKYEDIYEDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKKVPVPPKSVTSLMMNKDGFLGGMSVNTGEVFCSVPGRLSLLSSTSKYKVTVGEVQRRLSPPECLNASLLGGVLRRAKSKNGGRSLRERLEKIGLNLPAGRRKAANVTLLTSLVEGEAVHLARDFGYICETEFPAKAVSEYLNRQHTDPSDLHSRKNMLLATKQLCKEFTDLLAQDRTPIGNSRPSPILEPGIQSCLTHFSLITHGFGAPAICAALTALQNYLTEALKGMDKMFLNNTTTNRHTSGEGPGSKTGDKEEKHRK

SEQ ID NO: 67418 - protein, 452 aa, Homo sapiens
MSTTFPGLVHDAEIRHDGSNSYRLMQLGCLESVANSTVAYSSSSPLTYSTTGTEFASPYFSTNHQYTPLHHQSFHYEFQHSHPAVTPDAYSLNSLHHSQQYYQQIHHGEPTDFINLHNARALKSSCLDEQRRELGCLDAYRRHDLSLMSHGSQYGMHPDQRLLPGPSLGLAAAGADDLQGSVEAQCGLVLNGQGGVIRRGGTCVVNPTDLFCSVPGRLSLLSSTSKYKVTIAEVKRRLSPPECLNASLLGGILRRAKSKNGGRCLREKLDRLGLNLPAGRRKAANVTLLTSLVEGEALHLARDFGYTCETEFPAKAVGEHLARQHMEQKEQTARKKMILATKQICKEFQDLLSQDRSPLGSSRPTPILDLDIQRHLTHFSLITHGFGTPAICAALSTFQTVLSEMLNYLEKHTTHKNGGAADSGQGHANSEKAPLRKTSEAAVKEGKTEKTD

SEQ ID NO: 67419 - protein, 442 aa, Homo sapiens
MLVHTYSAMERPDGLGAAAGGARLSSLPQAAYGPAPPLCHTPAATAAAEFQPPYFPPPYPQPPLPYGQAPDAAAAFPHLAGDPYGGLAPLAQPQPPQAAWAAPRAAARAHEEPPGLLAPPARALGLDPRRDYATAVPRLLHGLADGAHGLADAPLGLPGLAAAPGLEDLQAMDEPGMSLLDQSVIKKVPIPSKASSLSALSLAKDSLVGGITNPGEVFCSVPGRLSLLSSTSKYKVTVGEVQRRLSPPECLNASLLGGVLRRAKSKNGGRCLRERLEKIGLNLPAGRRKAANVTLLTSLVEGEAVHLARDFGYVCETEFPAKAAAEYLCRQHADPGELHSRKSMLLAAKQICKEFADLMAQDRSPLGNSRPALILEPGVQSCLTHFSLITHGFGGPAICAALTAFQNYLLESLKGLDKMFLSSVGSGHGETKASEKDAKHRK

SEQ ID NO: 67420 - protein, 450 aa, Homo sapiens
MLWKITDNVKYEEDCEDRHDGSSNGNPRVPHLSSAGQHLYSPAPPLSHTGVAEYQPPPYFPPPYQQLAYSQSADPYSHLGEAYAAAINPLHQPAPTGSQQQAWPGRQSQEGAGLPSHHGRPAGLLPHLSGLEAGAVSARRDAYRRSDLLLPHAHALDAAGLAENLGLHDMPHQMDEVQNVDDQHLLLHDQTVIRKGPISMTKNPLNLPCQKELVGAVMNPTEVFCSVPGRLSLLSSTSKYKVTVAEVQRRLSPPECLNASLLGGVLRRAKSKNGGRSLREKLDKIGLNLPAGRRKAAHVTLLTSLVEGEAVHLARDFAYVCEAEFPSKPVAEYLTRPHLGGRNEMAARKNMLLAAQQLCKEFTELLSQDRTPHGTSRLAPVLETNIQNCLSHFSLITHGFGSQAICAAVSALQNYIKEALIVIDKSYMNPGDQSPADSNKTLEKMEKHRK

SEQ ID NO: 67421 - protein, 118 aa, Homo sapiens
MFLQDRHDGSSNGNPRVPHLSSAGQHLYSPAPPLSHTGVAEYQPPPYFPPPYQQLAYSQSADPYSHLGEAYAAAINPLHQPAPTGSQQQAWPGRQSQEGAGLPSHHGRPAGLLPHLSG

SEQ ID NO: 67422 - protein, 281 aa, Homo sapiens
MPHQMDEVQNVDDQHLLLHDQTVIRKGPISMTKNPLNLPCQKELVGAVMNPTEVFCSVPGRLSLLSSTSKYKVTVAEVQRRLSPPECLNASLLGGVLRRAKSKNGGRSLREKLDKIGLNLPAGRRKAAHVTLLTSLVEGEAVHLARDFAYVCEAEFPSKPVAEYLTRPHLGGRNEMAARKNMLLAAQQLCKEFTELLSQDRTPHGTSRLAPVLETNIQNCLSHFSLITHGFGSQAICAAVSALQNYIKEALIVIDKSYMNPGDQSPADSNKTLEKMEKHRK

SEQ ID NO: 67423 - protein, 346 aa, Homo sapiens
MAASGKLSTCRLPPLPTIREIIKLLRLQAAKQLSQNFLLDLRLTDKIVRKAGNLTNAYVYEVGPGPGGITRSILNADVAELLVVEKDTRFIPGLQMLSDAAPGKLRIVHGDVLTFKVEKAFSESLKRPWEDDPPNVHIIGNLPFSVSTPLIIKWLENISCRDGPFVYGRTQMTLTFQKEVAERLAANTGSKQRSRLSVMAQYLCNVRHIFTIPGQAFVPKPEVDVGVVHFTPLIQPKIEQPFKLVEKVVQNVFQFRRKYCHRGLRMLFPEAQRLESTGRLLELADIDPTLRPRQLSISHFKSLCDVYRKMCDEDPQLFAYNFREELKRRKSKNEEKEEDDAENYRL

SEQ ID NO: 67424 - protein, 575 aa, Homo sapiens
MSHAAEPARDGVEASAEGPRAVFVLLEERRPADSAQLLSLNSLLPESGIVADIELENVLDPDSFYELKSQPLPLRSSLPISLQATPATPATLSASSSAGGSRTPAMSSSSSSRVLLRQQLMRAQAQEQERRERREQAAAAPFPSPAPASPAISVVGVSAGGHTLSRPPPAQVPREVLKVQTHLENPTRYHLQQARRQQVKQYLSTTLGPKLASQALTPPPGPASAQPLPAPEAAHTTGPTGSAPNSPMALLTIGSSSEKEIDDVIDEIISLESSYNDEMLSYLPGGTTGLQLPSTLPVSGNLLDVYSSQGVATPAITVSNSCPAELPNIKREISETEAKALLKERQKKDNHNLIERRRRFNINDRIKELGTLIPKSSDPEMRWNKGTILKASVDYIRKLQKEQQRSKDLESRQRSLEQANRSLQLRIQELELQAQIHGLPVPPTPGLLSLATTSASDSLKPEQLDIEEEGRPGAATFHVGGGPAQNAPHQQPPAPPSDALLDLHFPSDHLGDLGDPFHLGLEDILMEEEEGVVGGLSGGALSPLRAASDPLLSSVSPAVSKASSRRSSFSMEEES

SEQ ID NO: 67425 - protein, 502 aa, Homo sapiens
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKAETNDSYHIILK

SEQ ID NO: 67426 - protein, 451 aa, Homo sapiens
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKAETNDSYHIILK

SEQ ID NO: 67427 - protein, 450 aa, Homo sapiens
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKETNDSYHIILK

SEQ ID NO: 67428 - protein, 479 aa, Homo sapiens
MLFWHTQPEHYNQHNSGSYLRDVLALPIFKQEEPQLSPENEARLPPLQYVLCAATSPAVKLHEETLTYLNQGQSYEIRLLENRKLGDFQDLNTKYVKSIIRVVFHDRRLQYTEHQQLEGWRWSRPGDRILDIDIPLSVGILDPRASPTQLNAVEFLWDPAKRASAFIQVHCISTEFTPRKHGGEKGVPFRVQIDTFKQNENGEYTEHLHSASCQIKVFKPKGADRKQKTDREKMEKRTAQEKEKYQPSYETTILTECSPWPDVAYQVNSAPSPSYNGSPNSFGLGEGNASPTHPVEALPVGSDHLLPSASIQDAQQWLHRNRFSQFCRLFASFSGADLLKMSRDDLVQICGPADGIRLFNAIKGRNVRPKMTIYVCQELEQNRVPLQQKRDGSGDSNLSVYHAIFLEELTTLELIEKIANLYSISPQHIHRVYRQGPTGIHVVVSNEMVQNFQDESCFVLSTIKAESNDGYHIILKCGL

SEQ ID NO: 67429 - protein, 32 aa, Homo sapiens
MVQNFQDESCFVLSTIKAESNDGYHIILKCGL

SEQ ID NO: 67430 - protein, 405 aa, Homo sapiens
MAKYVSLTEANEELKVLMDENQTSRPVAVHTSTVNPLGKQLLPKTFGQSSVNIDQQVVIGMPQRPAASNIPVVGSPNPPSTHFASQNQHSYSSPPWAGQHNRKGEKNGMGLCRLSMKVWETVQRKGTTSCQEVVGELVAKFRAASNHASPNESAYDVKNIKRRTYDALNVLMAMNIISREKKKIKWIGLTTNSAQNCQNLRVERQKRLERIKQKQSELQQLILQQIAFKNLVLRNQYVEEQVSQRPLPNSVIHVPFIIISSSKKTVINCSISDDKSEYLFKFNSSFEIHDDTEVLMWMGMTFGLESGSCSAEDLKMARNLVPKALEPYVTEMAQGTFGGVFTTAGSRSNGTWLSASDLTNIAIGMLATSSGGSQYSGSRVETPAVEEEEEEDNNDDDLSENDEDD

SEQ ID NO: 67431 - protein, 882 aa, Homo sapiens
MEGESSRFEIHTPVSDKKKKKCSIHKERPQKHSHEIFRDSSLVNEQSQITRRKKRKKDFQHLISSPLKKSRICDETANATSTLKKRKKRRYSALEVDEEAGVTVVLVDKENINNTPKHFRKDVDVVCVDMSIEQKLPRKPKTDKFQVLAKSHAHKSEALHSKVREKKNKKHQRKAASWESQRARDTLPQSESHQEESWLSVGPGGEITELPASAHKNKSKKKKKKSSNREYETLAMPEGSQAGREAGTDMQESQPTVGLDDETPQLLGPTHKKKSKKKKKKKSNHQEFEALAMPEGSQVGSEVGADMQESRPAVGLHGETAGIPAPAYKNKSKKKKKKSNHQEFEAVAMPESLESAYPEGSQVGSEVGTVEGSTALKGFKESNSTKKKSKKRKLTSVKRARVSGDDFSVPSKNSESTLFDSVEGDGAMMEEGVKSRPRQKKTQACLASKHVQEAPRLEPANEEHNVETAEDSEIRYLSADSGDADDSDADLGSAVKQLQEFIPNIKDRATSTIKRMYRDDLERFKEFKAQGVAIKFGKFSVKENKQLEKNVEDFLALTGIESADKLLYTDRYPEEKSVITNLKRRYSFRLHIGRNIARPWKLIYYRAKKMFDVNNYKGRYSEGDTEKLKMYHSLLGNDWKTIGEMVARSSLSVALKFSQISSQRNRGAWSKSETRKLIKAVEEVILKKMSPQELKEVDSKLQENPESCLSIVREKLYKGISWVEVEAKVQTRNWMQCKSKWTEILTKRMTNGRRIYYGMNALRAKVSLIERLYEINVEDTNEIDWEDLASAIGDVPPSYVQTKFSRLKAVYVPFWQKKTFPEIIDYLYETTLPLLKEKLEKMMEKKGTKIQTPAAPKQVFPFRDIFYYEDDSEGGHRKRKRR

SEQ ID NO: 67432 - protein, 905 aa, Homo sapiens
MEGESSRFEIHTPVSDKKKKKCSIHKERPQKHSHEIFRDSSLVNEQSQITRRKKRKKDFQHLISSPLKKSRICDETANATSTLKKRKKRRYSALEVDEEAGVTVVLVDKENINNTPKHFRKDVDVVCVDMSIEQKLPRKPKTDKFQVLAKSHAHKSEALHSKVREKKNKKHQRKAASWESQRARDTLPQSESHQEESWLSVGPGGEITELPASAHKNKSKKKKKKSSNREYETLAMPEGSQAGREAGTDMQESQPTVGLDDETPQLLGPTHKKKSKKKKKKKSNHQEFEALAMPEGSQVGSEVGADMQESRPAVGLHGETAGIPAPAYKNKSKKKKKKSNHQEFEAVAMPESLESAYPEGSQVGSEVGTVEGSTALKGFKESNSTKKKSKKRKLTSVKRARVSGDDFSVPSKNSESTLFDSVEGDGAMMEEGVKSRPRQKKTQACLASKHVQEAPRLEPANEEHNVETAEDSEIRYLSADSGDADDSDADLGSAVKQLQEFIPNIKDRATSTIKRMYRDDLERFKEFKAQGVAIKFGKFSVKENKQLEKNVEDFLALTGIESADKLLYTDRYPEEKSVITNLKRRYSFRLHIGRNIARPWKLIYYRAKKMFDVNNYKGRYSEGDTEKLKMYHSLLGNDWKTIGEMVARSSLSVALKFSQISSQRNRGAWSKSETRKLIKAVEEVILKKMSPQELKEVDSKLQENPESCLSIVREKLYKGISWVEVEAKVQTRNWMQCKSKWTEILTKRMTNGRRIYYGMNALRAKVSLIERLYEINVEDTNEIDWEDLASAIGDVPPSYVQTKFSRLKAVYVPFWQKKTFPEIIDYLYETTLPLLKEKLEKMMEKKGTKIQTPAAPKQVFPFRDIFYYEDDSEGEDIEKESEGQAPCMAHACNSSTLGGQGRWII

SEQ ID NO: 67433 - protein, 1162 aa, Homo sapiens
MEEVRCPEHGTFCFLKTGVRDGPNKGKSFYVCRADTCSFVRATDIPVSHCLLHEDFVVELQGLLLPQDKKEYRLFFRCIRSKAEGKRWCGSIPWQDPDSKEHSVSNKSQHASETFHHSSNWLRNPFKVLDKNQEPALWKQLIKGEGEEKKADKKQREKGDQLFDQKKEQKPEMMEKDLSSGLVPKKKQSVVQEKKQEEGAEIQCEAETGGTHKRDFSEIKSQQCQGNELTRPSASSQEKSSGKSQDVQRESEPLREKVTQLLPQNVHSHNSISKPQKGGPLNKEYTNWEAKETKAKDGPSIQATQKSLPQGHFQERPETHSVPAPGGPAAQAAPAAPGLSLGEGREAATSSDDEEEDDVVFVSSKPGSPLLFDSTLDLETKENLQFPDRSVQRKVSPASGVSKKVEPSDPVARRVYLTTQLKQKKSTLASVNIQALPDKGQKLIKQIQELEEVLSGLTLSPEQGTNEKSNSQVPQQSHFTKTTTGPPHLVPPQPLPRRGTQPVGSLELKSACQVTAGGSSQCYRGHTNQDHVHAVWKITSEAIGQLHRSLESCPGETVVAEDPAGLKVPLLLHQKQALAWLLWRESQKPQGGILADDMGLGKTLTMIALILTQKNQEKKEEKEKSTALTWLSKDDSCDFTSHGTLIICPASLIHHWKNEVEKRVNSNKLRVYLYHGPNRDSRARVLSTYDIVITTYSLVAKEIPTNKQEAEIPGANLNVEGTSTPLLRIAWARIILDEAHNVKNPRVQTSIAVCKLQACARWAVTGTPIQNNLLDMYSLLKFLRCSPFDEFNLWRSQVDNGSKKGGERLSILTKSLLLRRTKDQLDSTGRPLVILPQRKFQLHHLKLSEDEETVYNVFFARSRSALQSYLKRHESRGNQSGRSPNNPFSRVALEFGSEEPRHSEAADSPRSSTVHILSQLLRLRQCCCHLSLLKSALDPMELKGEGLVLSLEEQLSALTLSELRDSEPSSTVSLNGTFFKMELFEGMRESTKISSLLAELEAIQRNSASQKSVIVSQWTNMLKVVALHLKKHGLTYATIDGSVNPKQRMDLVEAFNHSRGPQVMLISLLAGGVGLNLTGGNHLFLLDMHWNPSLEDQACDRIYRVGQQKDVVIHRFVCEGTVEEKILQLQEKKKDLAKQVLSGSGESVTKLTLADLRVLFGI

SEQ ID NO: 67434 - protein, 143 aa, Homo sapiens
NMLKVVALHLKKHGLTYATIDGSVNPKQRMDLVEAFNHSRGPQVMLISLLAGGVGLNLTGGNHLFLLDMHWNPSLEDQACDRIYRVGQQKDVVIHRFVCEGTVEEKILQLQEKKKDLAKQVLSGSGESVTKLTLADLRVLFGI

SEQ ID NO: 67435 - protein, 420 aa, Homo sapiens
MAELGKKYCVYCLAEVSPLRFRCTECQDIELCPECFSAGAEIGHHRRYHGYQLVDGGRFTLWGPEAEGGWTSREEQLLLDAIEQFGFGNWEDMAAHVGASRTPQEVMEHYVSMYIHGNLGKACIPDTIPNRVTDHTCPSGGPLSPSLTTPLPPLDISVAEQQQLGYMPLRDDYEIEYDQDAETLISGLSVNYDDDDVEIELKRAHVDMYVRKLKERQRRKNIARDYNLVPAFLGKDKKEKEKALKRKITKEEKELRLKLRPLYQFMSCKEFDDLFENMHKEKMLRAKIRELQRYRRNGITKMEESAEYEAARHKREKRKENKNLAGSKRGKEDGKDSEFAAIENLPGFELLSDREKVLCSSLNLSPARYVTVKTIIIKDHLQKRQGIPSKSRLPSYLDKVLKKRILNFLTESGWISRDAS

SEQ ID NO: 67436 - protein, 121 aa, Homo sapiens
MAAHVGASRTPQEVMEHYVSMYIHGNLGKACIPDTIPNRVTDHTCPSGGPLSPSLTTPLPPLDISVAEQQQLGYMPLRDDYEIEYDQDAETLISGLSVNYDDDDVEIELKRAHVDMYVRKL

SEQ ID NO: 67437 - protein, 129 aa, Homo sapiens
MAAHVGASRTPQEVMEHYVSMYIHGNLGKACIPDTIPNRVTDHTCPSGGPLSPSLTTPLPPLDISVAEQQQLGYMPLRDDYEIEYDQDAETLISGLSVNYDDDDVEIELKRAHVDMYVRKLKERQRRKN

SEQ ID NO: 67438 - protein, 345 aa, Homo sapiens
MAELGKKYCVYCLAEEDMAAHVGASRTPQEVMEHYVSMYIHGNLGKACIPDTIPNRVTDHTCPSGGPLSPSLTTPLPPLDISVAEQQQLGYMPLRDDYEIEYDQDAETLISGLSVNYDDDDVEIELKRAHVDMYVRKLKERQRRKNIARDYNLVPAFLGKDKKEKEKALKRKITKEEKELRLKLRPLYQFMSCKEFDDLFENMHKEKMLRAKIRELQRYRRNGITKMEESAEYEAARHKREKRKENKNLAGSKRGKEDGKDSEFAAIENLPGFELLSDREKVLCSSLNLSPARYVTVKTIIIKDHLQKRQGIPSKSRLPSYLDKVLKKRILNFLTESGWISRDAS

SEQ ID NO: 67439 - protein, 328 aa, Homo sapiens
MAAHVGASRTPQEVMEHYVSMYIHGNLGKACIPDTIPNRVTDHTCPSGGPLSPSLTTPLPPLDISVAEQQQLGYMPLRDDYEIEYDQDAETLISGLSVNYDDDDVEIELKRAHVDMYVRKLKERQRRKNIARDYNLVPAFLGKDKKEKEKALKRKITKEEKELRLKLRPLYQFMSCKEFDDLFENMHKEKMLRAKIRELQRYRRNGITKMEESAEYEAARHKREKRKENKNLAGSKRGKEDGKDSEFAAIENLPGFELLSDREKVLCSSLNLSPARYVTVKTIIIKDHLQKRQGIPSKSRLPSYLDKVLKKRILNFLTESGWISRDAS

SEQ ID NO: 67440 - protein, 432 aa, Homo sapiens
MSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWASVEPYCADITSEEVRTLEELLKPPEDEAEHYKIPPLGKHYSQRWAQEDLLEEQKDGARAAAVADKKKGLMGPLTELDTKDVDALLKKSEAQHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHNRTKKHDLLRLAKEEVSRQELRQRVRMADNEVMDAFRKIMAARQKKRTPTKKEKDQAWKTLKERESILKLLDG

SEQ ID NO: 67441 - protein, 369 aa, Homo sapiens
MSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWASVEPYCADITSEEVRTLEELLKPPEDEAEHYKIPPLGKHYSQRWAQEDLLEEQKDGARAAAVADKKKGLMGPLTELDTKDVDALLKKSEAQHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHNRTKKHDLLR

SEQ ID NO: 67442 - protein, 95 aa, Homo sapiens
MSELKDCPLQFHDFKSVDHLKVCPRYTAVLARSEDDGIGIEELDTLQLELETLLSSASRRLRVLEAETQILTDWQDKKGDRRFLKLGRDHELGAP

SEQ ID NO: 67443 - protein, 432 aa, Homo sapiens; identical to SEQ ID NO: 67440

SEQ ID NO: 67444 - protein, 345 aa, Homo sapiens
MQLEIQVALNFIISYLYNKLPRRRVNIFGEELERLLKKKYEGHWYPEKPYKGSGFRCIHIGEKVDPVIEQASKESGLDIDDVRGNLPQDLSVWIDPFEVSYQIGEKGPVKVLYVDDNNENGCELDKEIKNSFNPEAQVFMPISDPASSVSSSPSPPFGHSAAVSPTFMPRSTQPLTFTTATFAATKFGSTKMKNSGRSNKVARTSPINLGLNVNDLLKQKAISSSMHSLYGLGLGSQQQPQQQQQPAQPPPPPPPPQQQQQQKTSALSPNAKEFIFPNMQGQGSSTNGMFPGDSPLNLSPLQYSNAFDVFAAYGGLNEKSFVDGLNFSLNNMQYSNQQFQPVMAN

SEQ ID NO: 67445 - protein, 345 aa, Homo sapiens; identical to SEQ ID NO: 67444

SEQ ID NO: 67446 - protein, 344 aa, Homo sapiens
MQLEIKVALNFIISYLYNKLPRRRADLFGEELERLLKKKYEGHWYPEKPLKGSGFRCVHIGEMVDPVVELAAKRSGLAVEDVRANVPEELSVWIDPFEVSYQIGEKGAVKVLYLDDSEGCGAPELDKEIKSSFNPDAQVFVPIGSQDSSLSNSPSPSFGQSPSPTFIPRSAQPITFTTASFAATKFGSTKMKKGGGAASGGGVASSGAGGQQPPQQPRMARSPTNSLLKHKSLSLSMHSLNFITANPAPQSQLSPNAKEFVYNGGGSPSLFFDAADGQGSGTPGPFGGSGAGTCNSSSFDMAQVFGGGANSLFLEKTPFVEGLSYNLNTMQYPSQQFQPVVLAN

SEQ ID NO: 67447 - protein, 101 aa, Homo sapiens
MQLEIKVALNFIISYLYNKLPRRRADLFGEELERLLKKKYEGHWYPEKPLKGSGFRCVHIGEMVDPVVELAAKRSGLAVEDVRANVPEELSVWIDPFEVSY

SEQ ID NO: 67448 - protein, 522 aa, Homo sapiens
MSITSDEVNFLVYRYLQESGFSHSAFTFGIESHISQSNINGTLVPPSALISILQKGLQYVEAEISINKDGTVFDSRPIESLSLIVAVIPDVVQMRQQAFGEKLTQQQASAAATEASAMAKAATMTPAAISQQNPPKNREATVNGEENGAHEINNHSKPMEIDGDVEIPPNKATVLRGHESEVFICAWNPVSDLLASGSGDSTARIWNLNENSNGGSTQLVLRHCIREGGHDVPSNKDVTSLDWNSDGTLLAMGSYDGFARIWTENGNLASTLGQHKGPIFALKWNKKGNYVLSAGVDKTTIIWDAHTGEAKQQFPFHSAPALDVDWQNNMTFASCSTDMCIHVCRLGCDHPVKTFQGHTNEVNAIKWDPSGMLLASCSDDMTLKIWSMKQDACVHDLQAHSKEIYTIKWSPTGPATSNPNSSIMLASASFDSTVRLWDVEQGVCTHTLMKHQEPVYSVAFSPDGKYLASGSFDKYVHIWNTQSGSLVHSYQGTGGIFEVCWNARGDKVGASASDGSVCVLDL

SEQ ID NO: 67449 - protein, 522 aa, Homo sapiens; identical to SEQ ID NO: 67448

SEQ ID NO: 67450 - protein, 522 aa, Homo sapiens; identical to SEQ ID NO: 67448

SEQ ID NO: 67451 - protein, 364 aa, Homo sapiens
MEIDGDVEIPPNKATVLRGHESEVFICAWNPVSDLLASGSGDSTARIWNLNENSNGGSTQLVLRHCIREGGHDVPSNKDVTSLDWNSDGTLLAMGSYDGFARIWTENGNLASTLGQHKGPIFALKWNKKGNYVLSAGVDKTTIIWDAHTGEAKQQFPFHSAPALDVDWQNNMTFASCSTDMCIHVCRLGCDHPVKTFQGHTNEVNAIKWDPSGMLLASCSDDMTLKIWSMKQDACVHDLQAHSKEIYTIKWSPTGPATSNPNSSIMLASASFDSTVRLWDVEQGVCTHTLMKHQEPVYSVAFSPDGKYLASGSFDKYVHIWNTQSGSLVHSYQGTGGIFEVCWNARGDKVGASASDGSVCVLDL

SEQ ID NO: 67452 - protein, 577 aa, Homo sapiens
MTELAGASSSCCHRPAGRGAMQSVLHHFQRLRGREGGSHFINTSSPRGEAKMSITSDEVNFLVYRYLQESGFSHSAFTFGIESHISQSNINGTLVPPAALISILQKGLQYVEAEISINEDGTVFDGRPIESLSLIDAVMPDVVQTRQQAFREKLAQQQASAAAAAAAATAAATAATTTSAGVSHQNPSKNREATVNGEENRAHSVNNHAKPMEIDGEVEIPSSKATVLRGHESEVFICAWNPVSDLLASGSGDSTARIWNLNENSNGGSTQLVLRHCIREGGHDVPSNKDVTSLDWNTNGTLLATGSYDGFARIWTEDGNLASTLGQHKGPIFALKWNRKGNYILSAGVDKTTIIWDAHTGEAKQQFPFHSAPALDVDWQNNTTFASCSTDMCIHVCRLGCDRPVKTFQGHTNEVNAIKWDPSGMLLASCSDDMTLKIWSMKQEVCIHDLQAHNKEIYTIKWSPTGPATSNPNSNIMLASASFDSTVRLWDIERGVCTHTLTKHQEPVYSVAFSPDGKYLASGSFDKCVHIWNTQSGNLVHSYRGTGGIFEVCWNARGDKVGASASDGSVCVLDLRK

SEQ ID NO: 67453 - protein, 526 aa, Homo sapiens
MSITSDEVNFLVYRYLQESGFSHSAFTFGIESHISQSNINGTLVPPAALISILQKGLQYVEAEISINEDGTVFDGRPIESLSLIDAVMPDVVQTRQQAFREKLAQQQASAAAAAAAATAAATAATTTSAGVSHQNPSKNREATVNGEENRAHSVNNHAKPMEIDGEVEIPSSKATVLRGHESEVFICAWNPVSDLLASGSGDSTARIWNLNENSNGGSTQLVLRHCIREGGHDVPSNKDVTSLDWNTNGTLLATGSYDGFARIWTEDGNLASTLGQHKGPIFALKWNRKGNYILSAGVDKTTIIWDAHTGEAKQQFPFHSAPALDVDWQNNTTFASCSTDMCIHVCRLGCDRPVKTFQGHTNEVNAIKWDPSGMLLASCSDDMTLKIWSMKQEVCIHDLQAHNKEIYTIKWSPTGPATSNPNSNIMLASASFDSTVRLWDIERGVCTHTLTKHQEPVYSVAFSPDGKYLASGSFDKCVHIWNTQSGNLVHSYRGTGGIFEVCWNARGDKVGASASDGSVCVLDLRK

SEQ ID NO: 67454 - protein, 577 aa, Homo sapiens; identical to SEQ ID NO: 67452

SEQ ID NO: 67455 - protein, 75 aa, Homo sapiens
MSITSDEVNFLVYRYLQESGFSHSAFTFGIESHISQSNINGTLVPPAALISILQKGLQYVEAEISINEDGTVFDG

SEQ ID NO: 67456 - protein, 45 aa, Homo sapiens
MSITSDEVNFLVYRYLQESGFSHSAFTFGIESHISQSNINGTLVP

SEQ ID NO: 67457 - protein, 526 aa, Homo sapiens; identical to SEQ ID NO: 67453

SEQ ID NO: 67458 - protein, 59 aa, Homo sapiens
MTELAGASSSCCHRPAGRGAMQSVLHHFQRLRGREGGSHFINTSSPRGEAKMSITSDEV

SEQ ID NO: 67459 - protein, 80 aa, Homo sapiens
MTELAGASSSCCHRPAGRGAMQSVLHHFQRLRGREGGSHFINTSSPRGEAKMSITSDEVNFLVYRYLQESGFSHSAFTFG

SEQ ID NO: 67460 - protein, 526 aa, Homo sapiens; identical to SEQ ID NO: 67453

SEQ ID NO: 67461 - protein, 447 aa, Homo sapiens
MELSQMSELMGLSVLLGLLALMATAAVARGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 67462 - protein, 446 aa, Homo sapiens [sequence omitted]

SEQ ID NO: 67463 - protein, 808 aa, Homo sapiens
MAETAAGVGRFKTNYAVERKIEPFYKGGKAQLDQTGQHLFCVCGTRVNILEVASGAVLRSLEQEDQEDITAFDLSPDNEVLVTASRALLLAQWAWQEGSVTRLWKAIHTAPVATMAFDPTSTLLATGGCDGAVRVWDIVRHYGTHHFRGSPGVVHLVAFHPDPTRLLLFSSATDAAIRVWSLQDRSCLAVLTAHYSAVTSLAFSADGHTMLSSGRDKICIIWDLQSCQATRTVPVFESVEAAVLLPEEPVSQLGVKSPGLYFLTAGDQGTLRVWEAASGQCVYTQAQPPGPGQELTHCTLAHTAGVVLTATADHNLLLYEARSLRLQKQFAGYSEEVLDVRFLGPEDSHVVVASNSPCLKVFELQTSACQILHGHTDIVLALDVFRKGWLFASCAKDQSVRIWRMNKAGQVMCVAQGSGHTHSVGTVCCSRLKESFLVTGSQDCTVKLWPLPKALLSKNTAPDNGPILLQAQTTQRCHDKDINSVAIAPNDKLLATGSQDRTAKLWALPQCQLLGVFSGHRRGLWCVQFSPMDQVLATASADGTIKLWALQDFSCLKTFEGHDASVLKVAFVSRGTQLLSSGSDGLVKLWTIKNNECVRTLDAHEDKVWGLHCSRLDDHALTGASDSRVILWKDVTEAEQAEEQARQEEQVVRQQELDNLLHEKRYLRALGLAISLDRPHTVLTVIQAIRRDPEACEKLEATMLRLRRDQKEALLRFCVTWNTNSRHCHEAQAVLGVLLRREAPEELLAYEGVRAALEALLPYTERHFQRLSRTLQAAAFLDFLWHNMKLPVPAAAPTPWETHKGALP

SEQ ID NO: 67464 - protein, 808 aa, Homo sapiens; identical to SEQ ID NO: 67463

SEQ ID NO: 67465 - protein, 242 aa, Homo sapiens
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGVRGLPGLPPTQQQLQAQHLSHGHGPPVPLTPHPSGLQPPGIPPLGGSAGLLALSSALSGQSHLAIKDDKKHHDAEHHRGERPGKSNSLLVPDSLRGTDKRRNGPEFSNDIKKRKVDDK

SEQ ID NO: 67466 - protein, 144 aa, Homo sapiens
MQRHYVMYYEMSYGLNIEMHKQTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRGERPGKPD

SEQ ID NO: 67467 - protein, 127 aa, Homo sapiens
MPTPGTSATPGLRPGLGKPPAIDPLVNQAAAGLRTPLAVPGPYPAPFGMVPHAGMNGELTSPGAAYASLHNMSPQMSAAAAAAAVVAYGRSPMVGFDPPPHMRVPTIPPNLAGIPGGKPSLVPAPAH

SEQ ID NO: 67468 - protein, 127 aa, Homo sapiens; identical to SEQ ID NO: 67467

SEQ ID NO: 67469 - protein, 770 aa, Homo sapiens
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDKDSSHYDSDGDKSDDNLVVDVSNEDPSSPRASPAHSPRENGIDKNRLLKKDASSSPASTASSASSTSLKSKEMSLHEKASTPVLKSSTPTPRSDMPTPGTSATPGLRPGLGKPPAIDPLVNQAAAGLRTPLAVPGPYPAPFGMVPHAGMNGELTSPGAAYASLHNMSPQMSAAAAAAAVVAYGRSPMVGFDPPPHMRVPTIPPNLAGIPGGKPAYSFHVTADGQMQPVPFPPDALIGPGIPRHARQINTLNHGEVVCAVTISNPTRHVYTGGKGCVKVWDISHPGNKSPVSQLDCLNRDNYIRSCKLLPDGCTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMESSNVEVLHVNKPDKYQLHLHESCVLSLKFAYCGKWFVSTGKDNLLNAWRTPYGASIFQSKESSSVLSCDISVDDKYIVTGSGDKKATVYEVIY

SEQ ID NO: 67470 - protein, 242 aa, Homo sapiens
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGVRGLPGLPPTQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDK

SEQ ID NO: 67471 - protein, 706 aa, Homo sapiens
MVQSRLTATSASQDSPASGLQTPLQSGQPFKFSILEICDRIKEEFQFLQAQYHSLKLECEKLASEKTEMQRHYVMYYEMSYGLNIEMHKQAEIVKRLSGICAQIIPFLTQEHQQQVLQAVERAKQVTVGELNSLIGQQQLQPLSHHAPPVPLTPRPAGLVGGSATGLLALSGALAAQAQLAAAVKEDRAGVEAEGSRVERAPSRSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCVQGVVLSPEL

SEQ ID NO: 67472 - protein, 743 aa, Homo sapiens
MYPQGRHPTPLQSGQPFKFSILEICDRIKEEFQFLQAQYHSLKLECEKLASEKTEMQRHYVMYYEMSYGLNIEMHKQAEIVKRLSGICAQIIPFLTQEHQQQVLQAVERAKQVTVGELNSLIGQQLQPLSHHAPPVPLTPRPAGLVGGSATGLLALSGALAAQAQLAAAVKEDRAGVEAEGSRVERAPSRSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 67473 - protein, 292 aa, Homo sapiens
LAHGEVVCAVTISGSTQHVYTGGKGCVKVWDVDGAVFAGQRGGAHQPIRNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 67474 - protein, 706 aa, Homo sapiens; identical to SEQ ID NO: 67471

SEQ ID NO: 67475 - protein, 360 aa, Homo sapiens
MYPQGRHPTPLQSGQPFKFSILEICDRIKEEFQFLQAQYHSLKLECEKLASEKTEMQRHYVMYYEMSYGLNIEMHKQAEIVKRLSGICAQIIPFLTQESASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPPWPSSTA

SEQ ID NO: 67476 - protein, 621 aa, Homo sapiens
MQRHYVMYYEMSYGLNIEMHKQAEIVKRLSGICAQIIPFLTQEHQQQVLQAVERAKQVTVGELNSLIGSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 67477 - protein, 410 aa, Homo sapiens
MTFPPALLPPNPVTPPRPRTLPPPGPARPVTSASLLPSQHLPRTASVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 67478 - protein, 686 aa, Homo sapiens
QTPLQSGQPFKFSILEICDRIKEEFQFLQAQYHSLKLECEKLASEKTEMQRHYVMYYEMSYGLNIEMHKQAEIVKRLSGICAQIIPFLTQEHQQQVLQAVERAKQVTVGELNSLIGQQQLQPLSHHAPPVPLTPRPAGLVGGSATGLLALSGALAAQAQLAAAVKEDRAGVEAEGSRVERAPSRSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCVQGVVLSPEL

SEQ ID NO: 67479 - protein, 621 aa, Homo sapiens; identical to SEQ ID NO: 67476

SEQ ID NO: 67480 - protein, 760 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 67481 - protein, 762 aa, Homo sapiens
MAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 67482 - protein, 764 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERSSASNNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPMVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 67483 - protein, 769 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 67484 - protein, 764 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPMVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 67485 - protein, 772 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIGIMASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 67486 - protein, 772 aa, Homo sapiens
MPPPPPLSCLRGLQAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIGIMASALRTPISITSSYAAPFAMMSHHEMNGSLTSPGAYAGLHNIPPQMSAAAAAAAAAYGRSPMVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 67487 - protein, 774 aa, Homo sapiens
MPPPPPLSCLRGLQAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 67488 - protein, 572 aa, Homo sapiens
MTSRDQPRPKGPPKSTSPCPGISNSESSPTLNYQGILNRLKQFPRFSPHFAAELESIYYSLHKIQQDVAEHHKQIGNVLQIVESCSQLQGFQSEEVSPAEPASPGTPQQVKDKTLQESSFEDIMATRSSDWLRRPLGEDNQPETQLFWDKEPWFWHDTLTEQLWRIFAGVHDEKAKPRDRQQAPGLGQESKAPGSCDPGTDPCPEDASTPRPPEASSSPPEGSQDRNTSWGVVQEPPGRASRFLQSISWDPEDFEDAWKRPDALPGQSKRLAVPCKLEKMRILAHGELVLATAISSFTRHVFTCGRRGIKVWSLTGQVAEDRFPESHLPIQTPGAFLRTCLLSSNSRSLLTGGYNLASVSVWDLAAPSLHVKEQLPCAGLNCQALDANLDANLAFASFTSGVVRIWDLRDQSVVRDLKGYPDGVKSIVVKGYNIWTGGPDACLRCWDQRTIMKPLEYQFKSQIMSLSHSPQEDWVLLGMANGQQWLQSTSGSQRHMVGQKDSVILSVKFSPFGQWWASVGMDDFLGVYSMPAGTKVFEVPEMSPVTCCDVSSNNRLVVTGSGEHASVYQITY

SEQ ID NO: 67489 - protein, 416 aa, Homo sapiens
MATRSSDWLRRPLGEDNQPETQLFWDKEPWFWHDTLTEQLWRIFAGVHDEKAKPRDRQQAPGLGQESKAPGSCDPGTDPCPEDASTPRPPEASSSPPEGSQDRNTSWGVVQEPPGRASRFLQSISWDPEDFEDAWKRPDALPGQSKRLAVPCKLEKMRILAHGELVLATAISSFTRHVFTCGRRGIKVWSLTGQVAEDRFPESHLPIQTPGAFLRTCLLSSNSRSLLTGGYNLASVSVWDLAAPSLHVKEQLPCAGLNCQALDANLDANLAFASFTSGVVRIWDLRDQSVVRDLKGYPDGVKSIVVKGYNIWTGGPDACLRCWDQRTIMKPLEYQFKSQIMSLSHSPQEDWVLLGMANGQQWLQSTSGSQRHMVGQRQRHPERQVLPLWPVVGKRWNGRLPWRLQHAGGDKSVRGA

SEQ ID NO: 67490 - protein, 572 aa, Homo sapiens [sequence omitted]

SEQ ID NO: 67491 - protein, 449 aa, Homo sapiens
MATRSSDWLRRPLGEDNQPETQLFWDKEPWFWHDTLTEQLWRIFAGVHDEKAKPRDRQQAPGLGQESKAPGSCDPGTDPCPEDASTPRPPEASSSPPEGSQDRNTSWGVVQEPPGRASRFLQSISWDPEDFEDAWKRPDALPGQSKRLAVPCKLEKMRILAHGELVLATAISSFTRHVFTCGRRGIKVWSLTGQVAEDRFPESHLPIQTPGAFLRTCLLSSNSRSLLTGGYNLASVSVWDLAAPSLHVKEQLPCAGLNCQALDANLDANLAFASFTSGVVRIWDLRDQSVVRDLKGYPDGVKSIVVKGYNIWTGGPDACLRCWDQRTIMKPLEYQFKSQIMSLSHSPQEDWVLLGMANGQQWLQSTSGSQRHMVGQKDSVILSVKFSPFGQWWASVGMDDFLGVYSMPAGTKVFEVPEMSPVTCCDVSSNNRLVVTGSGEHASVYQITY

SEQ ID NO: 67492 - protein, 571 aa, Homo sapiens
MNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAIAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 67493 - protein, 698 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAIAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 67494 - protein, 760 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 67495 - protein, 760 aa, Homo sapiens; identical to SEQ ID NO: 67494

SEQ ID NO: 67496 - protein, 478 aa, Homo sapiens
MDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 67497 - protein, 13 aa, Homo sapiens
MDQARSAFSNLDL

SEQ ID NO: 67498 - protein, 3830 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQAIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 67499 - protein, 3859 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNESISECGRCPLSPFCQFEEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQGKPTWSGMHSSSIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 67500 - protein, 71 aa, Homo sapiens
MAFVATQGATVVDQTTLMKKYLQFVAALTDVNTPDETKLKMMQEVSENFENVTSSPQYSTFLEHIIPRFLT

SEQ ID NO: 67501 - protein, 38 aa, Homo sapiens
MSDSGEQNYGERVNVEEGKCGSRHLTSFINEYLKLRNK

SEQ ID NO: 67502 - protein, 188 aa, Homo sapiens
MSTRRRHVGNRANPDPNCCLGVFGLSLYTTERDLREVFSKYGPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRGGGGGGGGWRAAQDRDQIYRRRSPSPYYSRGGYRSRSRSRSYSPRRY

SEQ ID NO: 67503 - protein, 288 aa, Homo sapiens
MSDSGEQNYGERESRSASRSGSAHGSGKSARHTPARSRSKEDSRRSRSKSRSRSESRSRSRRSSRRHYTRSRSRSRSHRRSRSRSYSRDYRRRHSHSHSPMSTRRRHVGNRANPDPNCCLGVFGLSLYTTERDLREVFSKYGPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRGGGGGGGGWRAAQDRDQIYRRRSPSPYYSRGGYRSRSRSRSYSPRRY

SEQ ID NO: 67504 - protein, 160 aa, Homo sapiens
MVPSAGQLALFALGIVLAACQALENSTSPLSADPPVAAAVVSHFNDCPDSHTQFCFHGTCRFLVQEDKPACVCHSGYVGARCEHADLLAVVAASQKKQAITALVVVSIVALAVLIITCVLIHCCQVRKHCEWCRALICRHEKPSALLKGRTACCHSETVV

SEQ ID NO: 67505 - protein, 159 aa, Homo sapiens
MVPSAGQLALFALGIVLAACQALENSTSPLSDPPVAAAVVSHFNDCPDSHTQFCFHGTCRFLVQEDKPACVCHSGYVGARCEHADLLAVVAASQKKQAITALVVVSIVALAVLIITCVLIHCCQVRKHCEWCRALICRHEKPSALLKGRTACCHSETVV

SEQ ID NO: 67506 - protein, 860 aa, Homo sapiens
MMSIKAFTLVSAVERELLMGDKERVNIECVECCGRDLYVGTNDCFVYHFLLEERPVPAGPATFTATKQLQRHLGFKKPVNELRAASALNRLLVLCDNSISLVNMLNLEPVPSGARIKGAATFALNENPVSGDPFCVEVCIISVKRRTIQMFLVYEDRVQIVKEVSTAEQPLAVAVDGHFLCLALTTQYIIHNYSTGVSQDLFPYCSEERPPIVKRIGRQEFLLAGPGGLGMFATVAGISQRAPVHWSENVIGAAVSFPYVIALDDEFITVHSMLDQQQKQTLPFKEGHILQDFEGRVIVATSKGVYILVPLPLEKQIQDLLASRRVEEALVLAKGARRNIPKEKFQVMYRRILQQAGFIQFAQLQFLEAKELFRSGQLDVRELISLYPFLLPTSSSFTRSHPPLHEYADLNQLTQGDQEKMAKCKRFLMSYLNEVRSTEVANGYKEDIDTALLKLYAEADHDSLLDLLVTENFCLLTDSAAWLEKHKKYFALGLLYHYNNQDAAAVQLWVNIVNGDVQDSTRSDLYEYIVDFLTYCLDEELVWAYADWVLQKSEEVGVQVFTKRPLDEQQKNSFNPDDIINCLKKYPKALVKYLEHLVIDKRLQKEEYHTHLAVLYLEEVLLQRASASGKGAEATETQAKLRRLLQKSDLYRVHFLLERLQGAGLPMESAILHGKLGEHEKALHILVHELQDFAAAEDYCLWCSEGRDPPHRQQLFHTLLAIYLHAGPTAHELAVAAVDLLNRHATEFDAAQVLQMLPDTWSVQLLCPFLMGAMRDSIHARRTMQVALGLARSENLIYTYDKMKLKGSSIQLSDKKLCQICQNPFCEPVFVRYPNGGLVHTHCAASRHTNPSSSSPGTRT

SEQ ID NO: 67507 - protein, 860 aa, Homo sapiens; identical to SEQ ID NO: 67506

SEQ ID NO: 67508 - protein, 315 aa, Homo sapiens
MLIGSCRKVKRSVQVFTKRPLDEQQKNSFNPDDIINCLKKYPKALVKYLEHLVIDKRLQKEEYHTHLAVLYLEEVLLQRASASGKGAEATETQAKLRRLLQKSDLYRVHFLLERLQGAGLPMESAILHGKLGEHEKALHILVHELQDFAAAEDYCLWCSEGRDPPHRQQLFHTLLAIYLHAGPTAHELAVAAVDLLNRHATEFDAAQVLQMLPDTWSVQLLCPFLMGAMRDSIHARRTMQVALGLARSENLIYTYDKMKLKGSSIQLSDKKLCQICQNPFCEPVFVRYPNGGLVHTHCAASRHTNPSSSSPGTRT

SEQ ID NO: 67509 - protein, 567 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 67510 - protein, 592 aa, Homo sapiens
MGRGLLRGLWPLHIVLWTRIASTIPPHVQKSDVEMEAQKDEIICPSCNRTAHPLRHINNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 67511 - protein, 112 aa, Homo sapiens
MCSCSSDECNDNIIFSEGRCKIRHIGSNNRLQRSTCQNTGWESAHVMKTPGFREYNTSNPDLLLVIFQVTGISLLPPLGVAISVIIIFYCYRVNRQQKLSSTWETGKTRKLM

SEQ ID NO: 67512 - protein, 397 aa, Homo sapiens
MCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 67513 - protein, 851 aa, Homo sapiens
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 67514 - protein, 850 aa, Homo sapiens
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 67515 - protein, 35 aa, Homo sapiens
MTSHYVIAIFALMSSCLATAGPEPGALCELSPVSA

SEQ ID NO: 67516 - protein, 850 aa, Homo sapiens; identical to SEQ ID NO: 67514

SEQ ID NO: 67517 - protein, 851 aa, Homo sapiens; identical to SEQ ID NO: 67513

SEQ ID NO: 67518 - protein, 683 aa, Homo sapiens
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPANRPQERGDELADSALEIFKQASAFSRPEQPQVLCSPVYQKLLERMKH

SEQ ID NO: 67519 - protein, 416 aa, Homo sapiens
MLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPANRPQERGDELADSALEIFKQASAFSRASQRSVRLAPVYQKLLERMKH

SEQ ID NO: 67520 - protein, 683 aa, Homo sapiens
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPANRPQERGDELADSALEIFKQASAFSRASQRSVRLAPVYQKLLERMKH

SEQ ID NO: 67521 - protein, 395 aa, Homo sapiens
MAFSPWQILSPVQWAKWTWSAVRGGAAGEDEAGGPEGDPEEEDSQAETKSLSFRSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 67522 - protein, 805 aa, Homo sapiens
MAFSPWQILSPVQWAKWTWSAVRGGAAGEDEAGGPEGDPEEEDSQAETKSLSFSSDSEGNFETPEAETPIRSPFKESCDPSLGLAGPGAKSQESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 67523 - protein, 379 aa, Homo sapiens
MGGSHSQTPRGREPAGERHPRPTETATTEQVKFLCFLLSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 67524 - protein, 367 aa, Homo sapiens
MGGSHSQTPRGREPAGERHPRPTETASGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 67525 - protein, 817 aa, Homo sapiens
MAFSPWQILSPVQWAKWTWSAVRGGAAGEDEAGGPEGDPEEEDSQAETKSLSFSSDSEGNFETPEAETPIRSPFKESCDPSLGLAGPGAKSQESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITTTEQVKFLCFLLSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 67526 - protein, 792 aa, Homo sapiens
MQRQTIKGAGAGGAALMAFSPWQILSPVQWAKWTWSAVRGGAAGEDEAGGPEGDPEEEDSQAETKSLSFSSDSEGNFETPEAETPIRSPFKESCDPSLGLAGPGAKSQESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 67527 - protein, 476 aa, Homo sapiens
MTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYFNKEVFRGDICPKRFGLQIPVIFKKQLTTKSLSLHRVTVKKLM

SEQ ID NO: 67528 - protein, 731 aa, Homo sapiens
MNNILKLKSSDSEGNFETPEAETPIRSPFKESCDPSLGLAGPGAKSQESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 67529 - protein, 610 aa, Homo sapiens
MTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 67530 - protein, 581 aa, Homo sapiens
MTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 67531 - protein, 30 aa, Homo sapiens
MTEGSMGVTLEASAEADLKAGNSCPELVPS

SEQ ID NO: 67532 - protein, 138 aa, Homo sapiens
MTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEA

SEQ ID NO: 67533 - protein, 61 aa, Homo sapiens
MTEGSMGVTLEASAEADLKAGNSCPELVPSRRSKLRKPKPVPLRKKAIGGEFSDTNAAVEG

SEQ ID NO: 67534 - protein, 129 aa, Homo sapiens
MAFSPWQILSPVQWAKWTWSAVRGGAAGEDEAGGPEGDPEEEDSQAETKSLSFSSDSEGNFETPEAETPIRSPFKESCDPSLGLAGPGAKSQESQEADEQLVAEVVEKCSSKTCSKPSENEVPQQAIDS

SEQ ID NO: 67535 - protein, 1026 aa, Homo sapiens
MGGSQSLQPAPASDLNLEASEAMSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEITAPEGSFASADALLSRLAHPVSLCGALDYLEPDLAEKNPPLFAQKLQEELEFAIMRIEALKLARQIALASRSHQDAKREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 67536 - protein, 2948 aa, Homo sapiens
MGNENSTSDNQRTLSAQTPRSAQPPGNSQNIKRKQQDTPGSPDHRDASSIGSVGLGGFCTASESSASLDPCLVSPEVTEPRKDPQGARGPEGSLLPSPPPSQEREHPSSSMPFAECPPEGCLASPAAAPEDGPQTQSPRREPAPNAPGDIAAAFPAERDSSTPYQEIAAVPSAGRERQPKEEGQKSSFSFSSGIDQSPGMSPVPLREPMKAPLCGEGDQPGGFESQEKEAAGGFPPAESRQGVASVQVTPEAPAAAQQGTESSAVLEKSPLKPMAPIPQDPAPRASDRERGQGEAPPQYLTDDLEFLRACHLPRSNSGAAPEAEVNAASQESCQQPVGAYLPHAELPWGLPSPALVPEAGGSGKEALDTIDVQGHPQTGMRGTKPNQVVCVAAGGQPEGGLPVSPEPSLLTPTEEAHPASSLASFPAAQIPIAVEEPGSSSRESVSKAGMPVSADAAKEVVDAGLVGLERQVSDLGSKGEHPEGDPGEVPAPSPQERGEHLNTEQSHEVQPGVPPPPLPKEQSHEVQPGAPPPPLPKAPSESARGPPGPTDGAKVHEDSTSPAVAKEGSRSPGDSPGGKEEAPEPPDGGDPGNLQGEDSQAFSSKRDPEVGKDELSKPSSDAESRDHPSSHSAQPPRKGGAGHTDGPHSQTAEADASGLPHKLGEEDPVLPPVPDGAGEPTVPEGAIWEGSGLQPKCPDTLQSREGLGRMESFLTLESEKSDFPPTPVAEVAPKAQEGESTLEIRKMGSCDGEGLLTSPDQPRGPACDASRQEFHAGVPHPPQGENLAADLGLTALILDQDQQGIPSCPGEGWIRGAASEWPLLSSEKHLQPSQAQPETSIFDVLKEQAQPPENGKETSPSHPGFKDQGADSSQIHVPVEPQEDNNLPTHGGQEQALGSELQSQLPKGTLSDTPTSSPTDMVWESSLTEESELSAPTRQKLPALGEKRPEGACGDGQSSRVSPPAADVLKDFSLAGNFSRKETCCTGQGPNKSQQALADALEEGSQHEEACQRHPGASEAADGCSPLWGLSKREMASGNTGEAPPCQPDSVALLDAVPCLPALAPASPGVTPTQDAPETEACDETQEGRQQPVPAPQQKMECWATSDAESPKLLASFPSAGEQGGEAGAAETGGSAGAGDPGKQQAPEKPGEATLSCGLLQTEHCLTSGEEASTSALRESCQAEHPMASCQDALLPARELGGIPRSTMDFSTHQAVPDPKELLLSGPPEVAAPDTPYLHVDSAAQRGAEDSGVKAVSSADPRAPGESPCPVGEPPLALENAASLKLFAGSLAPLLQPGAAGGEIPAVQASSGSPKARTTEGPVDSMPCLDRMPLLAKGKQATGEEKAATAPGAGAKASGEGMAGDAAGETEGSMERMGEPSQDPKQGTSGGVDTSSEQIATLTGFPDFREHIAKIFEKPVLGALATPGEKAGAGRSAVGKDLTRPLGPEKLLDGPPGVDVTLLPAPPARLQVEKKQQLAGEAEISHLALQDPASDKLLGPAGLTWERNLPGAGVGKEMAGVPPTLREDERPEGPGAAWPGLEGQAYSQLERSRQELASGLPSPAATQELPVERAAAFQVAPHSHGEEAVAQDRIPSGKQHQETSACDSPHGEDGPGDFAHTGVPGHVPRSTCAPSPQREVLTVPEANSEPWTLDTLGGERRPGVTAGILEMRNALGNQSTPAPPTGEVADTPLEPGKVAGAAGEAEGDITLSTAETQACASGDLPEAGTTRTFSVVAGDLVLPGSCQDPACSDKAPGMEGTAALHGDSPARPQQAKEQPGPERPIPAGDGKVCVSSPPEPDETHDPKLQHLAPEELHTDRESPRPGPSMLPSVPKKDAPRVMDKVTSDETRGAEGTESSPVADDIIQPAAPADLESPTLAASSYHGDVVGQVSTDLIAQSISPAAAHAGLPPSAAEHIVSPSAPAGDRVEASTPSCPDPAKDLSRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEITAPEGSFASADALLSRLAHPVSLCGALDYLEPDLAEKNPPLFAQKLQEELEFAIMRIEALKLARQIALASRSHQDAKREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 67537 - protein, 2861 aa, Homo sapiens
QRTLSAQTPRSAQPPGNSQNIKRKQQDTPGSPDHRDASSIGSVGLGGFCTASESSASLDPCLVSPEVTEPRKDPQGARGPEGSLLPSPPPSQEREHPSSSMPFAECPPEGCLASPAAAPEDGPQTQSPRREPAPNAPGDIAAAFPAERDSSTPYQEIAAVPSAGRERQPKEEGQKSSFSFSSGIDQSPGMSPVPLREPMKAPLCGEGDQPGGFESQEKEAAGGFPPAESRQGVASVQVTPEAPAAAQQGTESSAVLEKSPLKPMAPIPQDPAPRASDRERGQGEAPPQYLTDDLEFLRACHLPRSNSGAAPEAEVNAASQESCQQPVGAYLPHAELPWGLPSPALVPEAGGSGKEALDTIDVQGHPQTGMRGTKPNQVVCVAAGGQPEGGLPVSPEPSLLTPTEEAHPASSLASFPAAQIPIAVEEPGSSSRESVSKAGMPVSADAAKEVVDAGLVGLERQVSDLGSKGEHPEGDPGEVPAPSPQERGEHLNTEQSHEVQPGVPPPPLPKEQSHEVQPGAPPPPLPKAPSESARGPPGPTDGAKVHEDSTSPAVAKEGSRSPGDSPGGKEEAPEPPDGGDPGNLQGEDSQAFSSKRDPEVGKDELSKPSSDAESRDHPSSHSAQPPRKGGAGHTDGPHSQTAEADASGLPHKLGEEDPVLPPVPDGAGEPTVPEGAIWEGSGLQPKCPDTLQSREGLGRMESFLTLESEKSDFPPTPVAEVAPKAQEGESTLEIRKMGSCDGEGLLTSPDQPRGPACDASRQEFHAGVPHPPQGENLAADLGLTALILDQDQQGIPSCPGEGWIRGAASEWPLLSSEKHLQPSQAQPETSIFDVLKEQAQPPENGKETSPSHPGFKDQGADSSQIHVPVEPQEDNNLPTHGGQEQALGSELQSQLPKGTLSDTPTSSPTDMVWESSLTEESELSAPTRQKLPALGEKRPEGACGDGQSSRVSPPAADVLKDFSLAGNFSRKETCCTGQGPNKSQQALADALEEGSQHEEACQRHPGASEAADGCSPLWGLSKREMASGNTGEAPPCQPDSVALLDAVPCLPALAPASPGVTPTQDAPETEACDETQEGRQQPVPAPQQKMECWATSDAESPKLLASFPSAGEQGGEAGAAETGGSAGAGDPGKQQAPEKPGEATLSCGLLQTEHCLTSGEEASTSALRESCQAEHPMASCQDALLPARELGGIPRSTMDFSTHQAVPDPKELLLSGPPEVAAPDTPYLHVDSAAQRGAEDSGVKAVSSADPRAPGESPCPVGEPPLALENAASLKLFAGSLAPLLQPGAAGGEIPAVQASSGSPKARTTEGPVDSMPCLDRMPLLAKGKQATGEEKAATAPGAGAKASGEGMAGDAAGETEGSMERMGEPSQDPKQGTSGGVDTSSEQIATLTGFPDFREHIAKIFEKPVLGALATPGEKAGAGRSAVGKDLTRPLGPEKLLDGPPGVDVTLLPAPPARLQVEKKQQLAGEAEISHLALQDPASDKLLGPAGLTWERNLPGAGVGKEMAGVPPTLREDERPEGPGAAWPGLEGQAYSQLERSRQELASGLPSPAATQELPVERAAAFQVAPHSHGEEAVAQDRIPSGKQHQETSACDSPHGEDGPGDFAHTGVPGHVPRSTCAPSPQREVLTVPEANSEPWTLDTLGGERRPGVTAGILEMRNALGNQSTPAPPTGEVADTPLEPGKVAGAAGEAEGDITLSTAETQACASGDLPEAGTTRTFSVVAGDLVLPGSCQDPACSDKAPGMEGTAALHGDSPARPQQAKEQPGPERPIPAGDGKVCVSSPPEPDETHDPKLQHLAPEELHTDRESPRPGPSMLPSVPKKDAPRVMDKVTSDETRGAEGTESSPVADDIIQPAAPADLESPTLAASSYHGDVVGQVSTDLIAQSISPAAAHAGLPPSAAEHIVSPSAPAGDRVEASTPSCPDPAKDLSRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 67538 - protein, 1094 aa, Homo sapiens
MGNENSTSDNQRTLSAQTPRSAQPPGNSQNIKRKQQDTPGSPDHRDASSSPVADDIIQPAAPADLESPTLAASSYHGDVVGQVSTDLIAQRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEITAPEGSFASADALLSRLAHPVSLCGALDYLEPDLAEKNPPLFAQKLQEELEFAIMRIEALKLARQIALASRSHQDAKREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 67539 - protein, 996 aa, Homo sapiens
MGGSQSLQPAPASDLNLEASEAMSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEITAPEGSFASADALLSRLAHPVSLCGALDYLEPDLAEKNPPLFAQKLQREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 67540 - protein, 571 aa, Homo sapiens
MPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 67541 - protein, 2948 aa, Homo sapiens; identical to SEQ ID NO: 67536

SEQ ID NO: 67542 - protein, 2875 aa, Homo sapiens
MGNENSTSDNQRTLSAQTPRSAQPPGNSQNIKRKQQDTPGSPDHRDASSIGSVGLGGFCTASESSASLDPCLVSPEVTEPRKDPQGARGPEGSLLPSPPPSQEREHPSSSMPFAECPPEGCLASPAAAPEDGPQTQSPRREPAPNAPGDIAAAFPAERDSSTPYQEIAAVPSAGRERQPKEEGQKSSFSFSSGIDQSPGMSPVPLREPMKAPLCGEGDQPGGFESQEKEAAGGFPPAESRQGVASVQVTPEAPAAAQQGTESSAVLEKSPLKPMAPIPQDPAPRASDRERGQGEAPPQYLTDDLEFLRACHLPRSNSGAAPEAEVNAASQESCQQPVGAYLPHAELPWGLPSPALVPEAGGSGKEALDTIDVQGHPQTGMRGTKPNQVVCVAAGGQPEGGLPVSPEPSLLTPTEEAHPASSLASFPAAQIPIAVEEPGSSSRESVSKAGMPVSADAAKEVVDAGLVGLERQVSDLGSKGEHPEGDPGEVPAPSPQERGEHLNTEQSHEVQPGVPPPPLPKEQSHEVQPGAPPPPLPKAPSESARGPPGPTDGAKVHEDSTSPAVAKEGSRSPGDSPGGKEEAPEPPDGGDPGNLQGEDSQAFSSKRDPEVGKDELSKPSSDAESRDHPSSHSAQPPRKGGAGHTDGPHSQTAEADASGLPHKLGEEDPVLPPVPDGAGEPTVPEGAIWEGSGLQPKCPDTLQSREGLGRMESFLTLESEKSDFPPTPVAEVAPKAQEGESTLEIRKMGSCDGEGLLTSPDQPRGPACDASRQEFHAGVPHPPQGENLAADLGLTALILDQDQQGIPSCPGEGWIRGAASEWPLLSSEKHLQPSQAQPETSIFDVLKEQAQPPENGKETSPSHPGFKDQGADSSQIHVPVEPQEDNNLPTHGGQEQALGSELQSQLPKGTLSDTPTSSPTDMVWESSLTEESELSAPTRQKLPALGEKRPEGACGDGQSSRVSPPAADVLKDFSLAGNFSRKETCCTGQGPNKSQQALADALEEGSQHEEACQRHPGASEAADGCSPLWGLSKREMASGNTGEAPPCQPDSVALLDAVPCLPALAPASPGVTPTQDAPETEACDETQEGRQQPVPAPQQKMECWATSDAESPKLLASFPSAGEQGGEAGAAETGGSAGAGDPGKQQAPEKPGEATLSCGLLQTEHCLTSGEEASTSALRESCQAEHPMASCQDALLPARELGGIPRSTMDFSTHQAVPDPKELLLSGPPEVAAPDTPYLHVDSAAQRGAEDSGVKAVSSADPRAPGESPCPVGEPPLALENAASLKLFAGSLAPLLQPGAAGGEIPAVQASSGSPKARTTEGPVDSMPCLDRMPLLAKGKQATGEEKAATAPGAGAKASGEGMAGDAAGETEGSMERMGEPSQDPKQGTSGGVDTSSEQIATLTGFPDFREHIAKIFEKPVLGALATPGEKAGAGRSAVGKDLTRPLGPEKLLDGPPGVDVTLLPAPPARLQVEKKQQLAGEAEISHLALQDPASDKLLGPAGLTWERNLPGAGVGKEMAGVPPTLREDERPEGPGAAWPGLEGQAYSQLERSRQELASGLPSPAATQELPVERAAAFQVAPHSHGEEAVAQDRIPSGKQHQETSACDSPHGEDGPGDFAHTGVPGHVPRSTCAPSPQREVLTVPEANSEPWTLDTLGGERRPGVTAGILEMRNALGNQSTPAPPTGEVADTPLEPGKVAGAAGEAEGDITLSTAETQACASGDLPEAGTTRTFSVVAGDLVLPGSCQDPACSDKAPGMEGTAALHGDSPARPQQAKEQPGPERPIPAGDGKVCVSSPPEPDETHDPKLQHLAPEELHTDRESPRPGPSMLPSVPKKDAPRVMDKVTSDETRGAEGTERSAKDIGLWKAMMPSLDTDTLDVLERRVVLIQHEFLHKKEANGHSRFMYSSPVADDIIQPAAPADLESPTLAASSYHGDVVGQVSTDLIAQRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 67543 - protein, 1094 aa, Homo sapiens; identical to SEQ ID NO: 67538

SEQ ID NO: 67544 - protein, 838 aa, Homo sapiens
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAEEECKAETPHGAEEECRHGGVCAPAAVATSPPGAIPKEACGGAPLQGLPGEALGCPAGVGTPVPADGTQTLTCAHTSAPESTAPTNHLVAGRAMTLSPQEEVAAGQMASSSRSGPVKLEFDVSDGATSKRAPPPRRLGERSGLKPPLRKAAVRQQKAPQEVEEDDGRSGAGEDPPMPASRGSYHLDWDKMDDPNFIPFGGDTKSGCSEAQPPESPETRLGQPAAEQLHAGPATEEPGPCLSQQLHSASAEDTPVVQLAAETPTAESKERALNSASTSLPTSCPGSEPVPTHQQGQPALELKEESFRDPAEVLGTGAEVDYLEQFGTSSFKESALRKQSLYLKFDPLLRDSPGRPVPVATETSSMHGANETPSGRPREAKLVEFDFLGALDIPVPGPPPGVPAPGGPPLSTGPIVDLLQYSQKDLDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 67545 - protein, 145 aa, Homo sapiens
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKEKAAAFSLSGGHACGAVGSRDPNSREQGESLELCQHLASHKLSRQ

SEQ ID NO: 67546 - protein, 221 aa, Homo sapiens
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAE

SEQ ID NO: 67547 - protein, 231 aa, Homo sapiens
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAEEECKAETPHG

SEQ ID NO: 67548 - protein, 201 aa, Homo sapiens
MANKGPSYGMSREVQSKIEKKYDEELEERLVEWIIVQCGPDVGRPDRGRLGFQVWLKNGVILSKLVNSLYPDGSKPVKVPENPPSMVFKQMEQVAQFLKAAEDYGVIKTDMFQTVDLFEGKDMAAVQRTLMALGSLAVTKNDGHYRGDPNWFMKKAQEHKREFTESQLQEGKHVIGLQMGSNRGASQAGMTGYGRPRQIIS

SEQ ID NO: 67549 - protein, 35 aa, Homo sapiens
MANKGPSYGMSREVQPSRLACLTHTRVVPSALAKL

SEQ ID NO: 67550 - protein, 201 aa, Homo sapiens; identical to SEQ ID NO: 67548

SEQ ID NO: 67551 - protein, 201 aa, Homo sapiens; identical to SEQ ID NO: 67548

SEQ ID NO: 67552 - protein, 91 aa, Homo sapiens
MANKGPSYGMSREVQSKIEKKYDEELEERLVEWIIVQCGPDVGRPDRGRLGFQVWLKNGVILSKLVNSLYPDGSKPVKVPENPPSMVFKQM

SEQ ID NO: 67553 - protein, 201 aa, Homo sapiens; identical to SEQ ID NO: 67548

SEQ ID NO: 67554 - protein, 201 aa, Homo sapiens; identical to SEQ ID NO: 67548

SEQ ID NO: 67555 - protein, 199 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 67556 - protein, 220 aa, Homo sapiens
MSAFSLALALVSSPQPPPPIGMANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 67557 - protein, 199 aa, Homo sapiens; identical to SEQ ID NO: 67555

SEQ ID NO: 67558 - protein, 187 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQA

SEQ ID NO: 67559 - protein, 817 aa, Homo sapiens
MMDGPRSDVGRWGGNPLQPPTTPSPEPEPEPDGRSRRGGGRSFWARCCGCCSCRNAADDDWGPEPSDSRGRGSSSGTRRPGSRGSDSRRPVSRGSGVNAAGDGTIREGMLVVNGVDLLSSRSDQNRREHHTDEYEYDELIVRRGQPFHMLLLLSRTYESSDRITLELLIGNNPEVGKGTHVIIPVGKGGSGGWKAQVVKASGQNLNLRVHTSPNAIIGKFQFTVRTQSDAGEFQLPFDPRNEIYILFNPWCPEDIVYVDHEDWRQEYVLNESGRIYYGTEAQIGERTWNYGQFDHGVLDACLYILDRRGMPYGGRGDPVNVSRVISAMVNSLDDNGVLIGNWSGDYSRGTNPSAWVGSVEILLSYLRTGYSVPYGQCWVFAGVTTTVLRCLGLATRTVTNFNSAHDTDTSLTMDIYFDENMKPLEHLNHDSVWNFHVWNDCWMKRPDLPSGFDGWQVVDATPQETSSGIFCCGPCSVESIKNGLVYMKYDTPFIFAEVNSDKVYWQRQDDGSFKIVYVEEKAIGTLIVTKAISSNMREDITYLYKHPEGSDAERKAVETAAAHGSKPNVYANRGSAEDVAMQVEAQDAVMGQDLMVSVMLINHSSSRRTVKLHLYLSVTFYTGVSGTIFKETKKEVELAPGASDRVTMPVAYKEYRPHLVDQGAMLLNVSGHVKESGQVLAKQHTFRLRTPDLSLTLLGAAVVGQECEVQIVFKNPLPVTLTNVVFRLEGSGLQRPKILNVGDIGGNETVTLRQSFVPVRPGPRQLIASLDSPQLSQVHGVIQVDVAPAPGDGGFFSDAGGDSHLGETIPMASRGGA

SEQ ID NO: 67560 - protein, 375 aa, Homo sapiens
MKRPDLPSGFDGWQVVDATPQETSSGIFCCGPCSVESIKNGLVYMKYDTPFIFAEVNSDKVYWQRQDDGSFKIVYVEEKAIGTLIVTKAISSNMREDITYLYKHPEGSDAERKAVETAAAHGSKPNVYANRGSAEDVAMQVEAQDAVMGQDLMVSVMLINHSSSRRTVKLHLYLSVTFYTGVSGTIFKETKKEVELAPGASDRVTMPVAYKEYRPHLVDQGAMLLNVSGHVKESGQVLAKQHTFRLRTPDLSLTLLGAAVVGQECEVQIVFKNPLPVTLTNVVFRLEGSGLQRPKILNVGDIGGNETVTLRQSFVPVRPGPRQLIASLDSPQLSQVHGVIQVDVAPAPGDGGFFSDAGGDSHLGETIPMASRGGA

SEQ ID NO: 67561 - protein, 135 aa, Homo sapiens
MMDGPRSDVGRWGGNPLQPPTTPSPEPEPEPDGRSRRGGGRSFWARCCGCCSCRNAADDDWGPEPSDSRGRGSSSGTRRPGSRGSDSRRPVSRGSGVNAAGDGTIREGMLVVNGVDLLSSRSDQNRREHHTDEYE

SEQ ID NO: 67562 - protein, 42 aa, Homo sapiens
MMDGPRSDVGRWGGNPLQPPTTPSPEPEPEPDGRSRRGGGRS

SEQ ID NO: 67563 - protein, 65 aa, Homo sapiens
MMDGPRSDVGRWGGNPLQPPTTPSPEPEPEPDGRSRRGGGRSFWARCCGCCSCRNAADDDWGPEP

SEQ ID NO: 67564 - protein, 50 aa, Homo sapiens
MMDGPRSDVGRWGGNPLQPPTTPSPEPEPEPDGRSRRGGGRSFWARCCGC

SEQ ID NO: 67565 - protein, 9 aa, Homo sapiens
MMDGPRSDV

SEQ ID NO: 67566 - protein, 687 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 67567 - protein, 281 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFA

SEQ ID NO: 67568 - protein, 160 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYV

SEQ ID NO: 67569 - protein, 606 aa, Homo sapiens
MAEELVLERCDLELETNGRDHHTADLCREKLVVRRGQPFWLTLHFEGRNYEASVDSLTFSVVTADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 67570 - protein, 627 aa, Homo sapiens
MAEGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 67571 - protein, 693 aa, Homo sapiens
MAALGVQSINWQTAFNRQAHHTDKFSSQELILRRGQNFQVLMIMNKGLGSNERLEFIVSTGPYPSESAMTKAVFPLSNGSSGGWSAVLQASNGNTLTISISSPASAPIGRYTMALQIFSQGGISSVKLGTFILLFNPWLNVDSVFMGNHAEREEYVQEDAGIIFVGSTNRIGMIGWNFGQFEEDILSICLSILDRSLNFRRDAATDVASRNDPKYVGRVLSAMINSNDDNGVLAGNWSGTYTGGRDPRSWNGSVEILKNWKKSGFSPVRYGQCWVFAGTLNTALRSLGIPSRVITNFNSAHDTDRNLSVDVYYDPMGNPLDKGSDSVWNFHVWNEGWFVRSDLGPSYGGWQVLDATPQERSQGVFQCGPASVIGVREGDVQLNFDMPFIFAEVNADRITWLYDNTTGKQWKNSVNSHTIGRYISTKAVGSNARMDVTDKYKYPEGSDQERQVFQKALGKLKPNTPFAATSSMGLETEEQEPSIIGKLKVAGMLAVGKEVNLVLLLKNLSRDTKTVTVNMTAWTIIYNGTLVHEVWKDSATMSLDPEEEAEHPIKISYAQYEKYLKSDNMIRITAVCKVPDESEVVVERDIILDNPTLTLEVLNEARVRKPVNVQMLFSNPLDEPVRDCVLMVEGSGLLLGNLKIDVPTLGPKEGSRVRFDILPSRSGTKQLLADFSCNKFPAIKAMLSIDVAE

SEQ ID NO: 67572 - protein, 533 aa, Homo sapiens
MAALGVQSINWQTAFNRQAHHTDKFSSQELILRRGQNFQVLMIMNKGLGSNERLEFIVSTGPYPSESAMTKAVFPLSNGSSGGWSAVLQASNGNTLTISISSPASAPIGRYTMALQIFSQGGISSVKLGTFILLFNPWLNVDSVFMGNHAEREEYVQEDAGIIFVGSTNRIGMIGWNFGQFEEDILSICLSILDRSLNFRRDAATDVASRNDPKYVGRVLSAMINSNDDNGVLAGNWSGTYTGGRDPRSWNGSVEILKNWKKSGFSPVRYGQCWVFAGTLNTALRSLGIPSRVITNFNSAHDTDRNLSVDVYYDPMGNPLDKGSDSVWNFHVWNEGWFVRSDLGPSYGGWQVLDATPQERSQGVFQCGPASVIGVREGDVQLNFDMPFIFAEVNADRITWLYDNTTGKQWKNSVNSHTIGRYISTKAVGSNARMDVTDKYKYPEGSDQERQVFQKALGKLKPNTPFAATSSMGLETEEQEPSIIGKLKVAGMLAVGKEVNLVLLLIPHALQCCRMDWPLTQGLSKRDTGEKLV

SEQ ID NO: 67573 - protein, 684 aa, Homo sapiens
MMDASKELQVLHIDFLNQDNAVSHHTWEFQTSSPVFRRGQVFHLRLVLNQPLQSYHQLKLEFSTGPNPSIAKHTLVVLDPRTPSDHYNWQATLQNESGKEVTVAVTSSPNAILGKYQLNVKTGNHILKSEENILYLLFNPWCKEDMVFMPDEDERKEYILNDTGCHYVGAARSIKCKPWNFGQFEKNVLDCCISLLTESSLKPTDRRDPVLVCRAMCAMMSFEKGQGVLIGNWTGDYEGGTAPYKWTGSAPILQQYYNTKQAVCFGQCWVFAGILTTVLRALGIPARSVTGFDSAHDTERNLTVDTYVNENGEKITSMTHDSVWNFHVWTDAWMKRPDLPKGYDGWQAVDATPQERSQGVFCCGPSPLTAIRKGDIFIVYDTRFVFSEVNGDRLIWLVKMVNGQEELHVISMETTSIGKNISTKAVGQDRRRDITYEYKYPEGSSEERQVMDHAFLLLSSEREHRRPVKENFLHMSVQSDDVLLGNSVNFTVILKRKTAALQNVNILGSFELQLYTGKKMAKLCDLNKTSQIQGQVSEVTLTLDSKTYINSLAILDDEPVIRGFIIAEIVESKEIMASEVFTSFQYPEFSIELPNTGRIGQLLVCNCIFKNTLAIPLTDVKFSLESLGISSLQTSDHGTVQPGETIQSQIKCTPIKTGPKKFIVKLSSKQVKEINAQKIVLITK

SEQ ID NO: 67574 - protein, 720 aa, Homo sapiens
MAQGLEVALTDLQSSRNNVRHHTEEITVDHLLVRRGQAFNLTLYFRNRSFQPGLDNIIFVVETGPLPDLALGTRAVFSLARHHSPSPWIAWLETNGATSTEVSLCAPPTAAVGRYLLKIHIDSFQGSVTAYQLGEFILLFNPWCPEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 67575 - protein, 638 aa, Homo sapiens
MAQGLEVALTDLQSSRNNVRHHTEEITVDHLLVRRGQAFNLTLYFRNRSFQPGLDNIIFVVETEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 67576 - protein, 719 aa, Homo sapiens
AQGLEVALTDLQSSRNNVRHHTEEITVDHLLVRRGQAFNLTLYFRNRSFQPGLDNIIFVVETGPLPDLALGTRAVFSLARHHSPSPWIAWLETNGATSTEVSLCAPPTAAVGRYLLKIHIDSFQGSVTAYQLGEFILLFNPWCPEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 67577 - protein, 706 aa, Homo sapiens
MAGIRVTKVDWQRSRNGAAHHTQEYPCPELVVRRGQSFSLTLELSRALDCEEILIFTMETGPRASEALHTKAVFQTSELERGEGWTAAREAQMEKTLTVSLASPPSAVIGRYLLSIRLSSHRKHSNRRLGEFVLLFNPWCAEDDVFLASEEERQEYVLSDSGIIFRGVEKHIRAQGWNYGQFEEDILNICLSILDRSPGHQNNPATDVSCRHNPIYVTRVISAMVNSNNDRGVVQGQWQGKYGGGTSPLHWRGSVAILQKWLKGRYKPVKYGQCWVFAGVLCTVLRCLGIATRVVSNFNSAHDTDQNLSVDKYVDSFGRTLEDLTEDSMWNFHVWNESWFARQDLGPSYNGWQVLDATPQEESEGVFRCGPASVTAIREGDVHLAHDGPFVFAEVNADYITWLWHEDESRERVYSNTKKIGRCISTKAVGSDSRVDITDLYKYPEGSRKERQVYSKAVNRLFGVEASGRRIWIRRAGGRCLWRDDLLEPATKPSIAGKFKVLEPPMLGHDLRLALCLANLTSRAQRVRVNLSGATILYTRKPVAEILHESHAVRLGPQEEKRIPITISYSKYKEDLTEDKKILLAAMCLVTKGEKLLVEKDITLEDFITIKVLGPAMVGVAVTVEVTVVNPLIERVKDCALMVEGSGLLQEQLSIDVPTLEPQERASVQFDITPSKSGPRQLQVDLVSPHFPDIKGFVIVHVATAK

SEQ ID NO: 67578 - protein, 625 aa, Homo sapiens
MAGIRVTKVDWQRSRNGAAHHTQEYPCPELVVRRGQSFSLTLELSRALDCEEILIFTMETGPRASEALHTKAVFQTSELERGEGWTAAREAQMEKTLTVSLASPPSAVIGRYLLSIRLSSHRKHSNRRLGEFVLLFNPWCAEDDVFLASEEERQEYVLSDSGIIFRGVEKHIRAQGWNYGQFEEDILNICLSILDRSPGHQNNPATDVSCRHNPIYVTRVISAMVNSNNDRGVVQGQWQGKYGGGTSPLHWRGSVAILQKWLKGRYKPVKYGQCWVFAGVLCTVLRCLGIATRVVSNFNSAHDTDQNLSVDKYVDSFGRTLEDLTEDSMWNFHVWNESWFARQDLGPSYNGWQVLDATPQEESEGVFRCGPASVTAIREGDVHLAHDGPFVFAEVNADYITWLWHEDESRERVYSNTKKIGRCISTKAVGSDSRVDITDLYKYPEGSRKERQVYSKAVNRLFGVEASGRRIWIRRAGGRCLWRDDLLEPATKPSIAGKFKVLEPPMLGHDLRLALCLANLTSRAQRVRVNLSGATILYTRKPVAEILHESHAVRLGPQEEKRIPITISYSKYKEDLTEDKKILLAAMCLVTKGEKLLVEKDITLEDFITIKRAYPGASGEGLSPV

SEQ ID NO: 67579 - protein, 710 aa, Homo sapiens
MDQVATLRLESVDLQSSRNNKEHHTQEMGVKRLTVRRGQPFYLRLSFSRPFQSQNDHITFVAETGPKPSELLGTRATFFLTRVQPGNVWSASDFTIDSNSLQVSLFTPANAVIGHYTLKIEISQGQGHSVTYPLGTFILLFNPWSPEDDVYLPSEILLQEYIMRDYGFVYKGHERFITSWPWNYGQFEEDIIDICFEILNKSLYHLKNPAKDCSQRNDVVYVCRVVSAMINSNDDNGVLQGNWGEDYSKGVSPLEWKGSVAILQQWSARGGQPVKYGQCWVFASVMCTVMRCLGVPTRVVSNFRSAHNVDRNLTIDTYYDRNAEMLSTQKRDKIWNFHVWNECWMIRKDLPPGYNGWQVLDPTPQQTSSGLFCCGPASVKAIREGDVHLAYDTPFVYAEVNADEVIWLLGDGQAQEILAHNTSSIGKEISTKMVGSDQRQSITSSYKYPEGSPEERAVFMKASRKMLGPQRASLPFLDLLESGGLRDQPAQLQLHLARIPEWGQDLQLLLRIQRVPDSTHPRGPIGLVVRFCAQALLHGGGTQKPFWRHTVRMNLDFGKETQWPLLLPYSNYRNKLTDEKLIRVSGIAEVEETGRSMLVLKDICLEPPHLSIEVSERAEVGKALRVHVTLTNTLMVALSSCTMVLEGSGLINGQIAKDLGTLVAGHTLQIQLDLYPTKAGPRQLQVLISSNEVKEIKGYKDIFVTVAGAP

SEQ ID NO: 67580 - protein, 281 aa, Homo sapiens
MRFVVALVLLNVAAAGAVPLLATESVKQEEAGVRPSAGNVSTHPSLSQRPGGSTKSHPEPQTPKDSPSKSSSEAQTTKDVPNKSGADGQTPKDGSSKSGAEDQTPKDVPNKSGAEKQTPKDGSNKSGAEEQGPIDGPSKSGAEEQTSKDSPNKEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKS

SEQ ID NO: 67581 - protein, 437 aa, Homo sapiens
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTSKDSPNKVVPEQPSRKDHSKPISNPSDNKELPKADTNQLADKGKLSPHAFKTESGEETDLISPPQEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKS

SEQ ID NO: 67582 - protein, 379 aa, Homo sapiens
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTSKDSPNKEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKS

SEQ ID NO: 67583 - protein, 453 aa, Homo sapiens
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTSKDSPNKVVPEQPSRKDHSKPISNPSDNKELPKADTNQLADKGKLSPHAFKTESGEETDLISPPQEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKIFFPLSPNRMVYSSGKR

SEQ ID NO: 67584 - protein, 230 aa, Homo sapiens
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGG

SEQ ID NO: 67585 - protein, 839 aa, Homo sapiens [sequence omitted]

SEQ ID NO: 67586 - protein, 790 aa, Homo sapiens
MKAHPKEMVPLMGKRVAAPSGNPAILPEKRPAEITPTKKSAHFFLEIEGFEPNPTVAKTSPPVFSKPMDSNIRQCISGNCDDMDSPQSPQDDVTETPSNPNSPSAQLAKEEQRRKKRRLKKRIFAAVSEGCVEELVELLVELQELCRRRHDEDVPDFLMHKLTASDTGKTCLMKALLNINPNTKEIVRILLAFAEENDILGRFINAEYTEEAYEGQTALNIAIERRQGDIAALLIAAGADVNAHAKGAFFNPKYQHEGFYFGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFFIQAVLVILSVFLYLFAYKEYLACLVLAMALGWANMLYYTRGFQSMGMYSVMIQKVILHDVLKFLFVYIVFLLGFGVALASLIEKCPKDNKDCSSYGSFSDAVLELFKLTIGLGDLNIQQNSKYPILFLFLLITYVILTFVLLLNMLIALMGETVENVSKESERIWRLQRARTILEFEKMLPEWLRSRFRMGELCKVAEDDFRLCLRINEVKWTEWKTHVSFLNEDPGPVRRTDFNKIQDSSRNNSKTTLNAFEEVEEFPETSV

SEQ ID NO: 67587 - protein, 1119 aa, Homo sapiens
MKRSLRKMWRPGEKKEPQGVVYEDVPDDTEDFKESLKVVFEGSAYGLQNFNKQKKLKRCDDMDTFFLHYAAAEGQIELMEKITRDSSLEVLHEMDDYGNTPLHCAVEKNQIESVKFLLSRGANPNLRNFNMMAPLHIAVQGMNNEVMKVLLEHRTIDVNLEGENGNTAVIIACTTNNSEALQILLKKGAKPCKSNKWGCFPIHQAAFSGSKECMEIILRFGEEHGYSRQLHINFMNNGKATPLHLAVQNGDLEMIKMCLDNGAQIDPVEKGRCTAIHFAATQGATEIVKLMISSYSGSVDIVNTTDGCHETMLHRASLFDHHELADYLISVGADINKIDSEGRSPLILATASASWNIVNLLLSKGAQVDIKDNFGRNFLHLTVQQPYGLKNLRPEFMQMQQIKELVMDEDNDGCTPLHYACRQGGPGSVNNLLGFNVSIHSKSKDKKSPLHFAASYGRINTCQRLLQDISDTRLLNEGDLHGMTPLHLAAKNGHDKVVQLLLKKGALFLSDHNGWTALHHASMGGYTQTMKVILDTNLKCTDRLDEDGNTALHFAAREGHAKAVALLLSHNADIVLNKQQASFLHLALHNKRKEVVLTIIRSKRWDECLKIFSHNSPGNKCPITEMIEYLPECMKVLLDFCMLHSTEDKSCRDYYIEYNFKYLQCPLEFTKKTPTQDVIYEPLTALNAMVQNNRIELLNHPVCKEYLLMKWLAYGFRAHMMNLGSYCLGLIPMTILVVNIKPGMAFNSTGIINETSDHSEILDTTNSYLIKTCMILVFLSSIFGYCKEAGQIFQQKRNYFMDISNVLEWIIYTTGIIFVLPLFVEIPAHLQWQCGAIAVYFYWMNFLLYLQRFENCGIFIVMLEVILKTLLRSTVVFIFLLLAFGLSFYILLNLQDPFSSPLLSIIQTFSMMLGDINYRESFLEPYLRNELAHPVLSFAQLVSFTIFVPIVLMNLLIGLAVGDIAEVQKHASLKRIAMQVELHTSLEKKLPLWFLRKVDQKSTIVYPNKPRSGGMLFHIFCFLFCTGEIRQEIPNADKSLEMEILKQKYRLKDLTFLLEKQHELIKLIIQKMEIISETEDDDSHCSFQDRFKKEQMEQRNSRWNTVLRAVKAKTHHLEP

SEQ ID NO: 67588 - protein, 759 aa, Homo sapiens
MMAALYPSTDLSGASSSSLPSSPSSSSPNEVMALKDVREVKEENTLNEKLFLLACDKGDYYMVKKILEENSSGDLNINCVDVLGRNAVTITIENENLDILQLLLDYGCQKLMERIQNPEYSTTMDVAPVILAAHRNNYEILTMLLKQDVSLPKPHAVGCECTLCSAKNKKDSLRHSRFRLDIYRCLASPALIMLTEEDPILRAFELSADLKELSLVEVEFRNDYEELARQCKMFAKDLLAQARNSRELEVILNHTSSDEPLDKRGLLEERMNLSRLKLAIKYNQKEFVSQSNCQQFLNTVWFGQMSGYRRKPTCKKIMTVLTVGIFWPVLSLCYLIAPKSQFGRIIHTPFMKFIIHGASYFTFLLLLNLYSLVYNEDKKNTMGPALERIDYLLILWIIGMIWSDIKRLWYEGLEDFLEESRNQLSFVMNSLYLATFALKVVAHNKFHDFADRKDWDAFHPTLVAEGLFAFANVLSYLRLFFMYTTSSILGPLQISMGQMLQDFGKFLGMFLLVLFSFTIGLTQLYDKGYTSKEQKDCVGIFCEQQSNDTFHSFIGTCFALFWYIFSLAHVAIFVTRFSYGEELQSFVGAVIVGTYNVVVVIVLTKLLVAMLHKSFQLIANHEDKEWKFARAKLWLSYFDDKCTLPPPFNIIPSPKTICYMISSLSKWICSHTSKGKVKRQNSLKEWRNLKQKRDENYQKVMCCLVHRYLTSMRQKMQSTDQATVENLNELRQDLSKFRNEIRDLLGFRTSKYAMFYPRN

SEQ ID NO: 67589 - protein, 144 aa, Homo sapiens
MIWSDIKRLWYEGLEDFLEESRNQLSFVMNSLYLATFALKVVAHNKISMGQMLQDFGKFLGMFLLVLFSFTIGLTQLYDKGYTSKEQKDCVGIFCEQQSNDTFHSFIGTCFALFWYIFSLAHVAIFVTRFSYGEELQSFVGAVI

SEQ ID NO: 67590 - protein, 793 aa, Homo sapiens
MMAALYPSTDLSGASSSSLPSSPSSSSPNEVMALKDVREVKEENTLNEKLFLLACDKGDYYMVKKILEENSSGDLNINCVDVLGRNAVTITIENENLDILQLLLDYGCQSADALLVAIDSEVVGAVDILLNHRPKRSSRPTIVKLMERIQNPEYSTTMDVAPVILAAHRNNYEILTMLLKQDVSLPKPHAVGCECTLCSAKNKKDSLRHSRFRLDIYRCLASPALIMLTEEDPILRAFELSADLKELSLVEVEFRNDYEELARQCKMFAKDLLAQARNSRELEVILNHTSSDEPLDKRGLLEERMNLSRLKLAIKYNQKEFVSQSNCQQFLNTVWFGQMSGYRRKPTCKKIMTVLTVGIFWPVLSLCYLIAPKSQFGRIIHTPFMKFIIHGASYFTFLLLLNLYSLVYNEDKKNTMGPALERIDYLLILWIIGMIWSDIKRLWYEGLEDFLEESRNQLSFVMNSLYLATFALKVVAHNKFHDFADRKDWDAFHPTLVAEGLFAFANVLSYLRLFFMYTTSSILGPLQISMGQMLQDFGKFLGMFLLVLFSFTIGLTQLYDKGYTSKEQKDCVGIFCEQQSNDTFHSFIGTCFALFWYIFSLAHVAIFVTRFSYGEELQSFVGAVIVGTYNVVVVIVLTKLLVAMLHKSFQLIANHEDKEWKFARAKLWLSYFDDKCTLPPPFNIIPSPKTICYMISSLSKWICSHTSKGKVKRQNSLKEWRNLKQKRDENYQKVMCCLVHRYLTSMRQKMQSTDQATVENLNELRQDLSKFRNEIRDLLGFRTSKYAMFYPRN

SEQ ID NO: 67591 - protein, 804 aa, Homo sapiens
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGRRAADNLRRHHQYQEVMRNLVKRYVAAMIRDAKTEEGLTEENFKELKQDISSFRFEVLGLLRGSKLSTIQSANASKESSNSADSDEKSDSEGNSKDKKKNFSLFDLTTLIHPRSAAIASERHNISNGSALVVQEPPREKQRKVNFVTDIKNFGLFHRRSKQNAAEQNANQIFSVSEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 67592 - protein, 836 aa, Homo sapiens
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGRRAADNLRRHHQYQEVMRNLVKRYVAAMIRDAKTEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 67593 - protein, 893 aa, Homo sapiens
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGRRAADNLRRHHQYQEVMRNLVKRYVAAMIRDAKTEEGLTEENFKELKQDISSFRFEVLGLLRGSKLSTIQSANASKESSNSADSDEKSDSEEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 67594 - protein, 828 aa, Homo sapiens
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIARRAADNLRRHHQYQEVMRNLVKRYVAAMIRDAKTEEGLTEENFKELKQDISSFRFEVLGLLRGSKLSTIQSANASKESSNSADSDEKSDSEEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 67595 - protein, 804 aa, Homo sapiens; identical to SEQ ID NO: 67591

SEQ ID NO: 67596 - protein, 982 aa, Homo sapiens
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGVRTQHRRAADNLRRHHQYQEVMRNLVKRYVAAMIRDAKTEEGLTEENFKELKQDISSFRFEVLGLLRGSKLSTIQSANASKESSNSADSDEKSDSEGNSKDKKKNFSLFDLTTLIHPRSAAIASERHNISNGSALVVQEPPREKQRKVNFVTDIKNFGLFHRRSKQNAAEQNANQIFSVSEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 67597 - protein, 977 aa, Homo sapiens
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGRRAADNLRRHHQYQEVMRNLVKRYVAAMIRDAKTEEGLTEENFKELKQDISSFRFEVLGLLRGSKLSTIQSANASKESSNSADSDEKSDSEGNSKDKKKNFSLFDLTTLIHPRSAAIASERHNISNGSALVVQEPPREKQRKVNFVTDIKNFGLFHRRSKQNAAEQNANQIFSVSEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 67598 - protein, 460 aa, Homo sapiens
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKVI

SEQ ID NO: 67599 - protein, 836 aa, Homo sapiens; identical to SEQ ID NO: 67592

SEQ ID NO: 67600 - protein, 797 aa, Homo sapiens
MAAAPVAAGSGAGRGRRSAATVAAWGGWGGRPRPGNILLQLRQGQLTGRGLVRAVQFTETFLTERDKQSKWSGIPQLLLKLHTTSHLHSDFVECQNILKEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALVSYIEEPYMDIDRDFTEE

SEQ ID NO: 67601 - protein, 758 aa, Homo sapiens
MAAAPVAAGSGAGRGRRSAATVAAWGGWGGRPRPGNILLQLRQGQLTGRGLVRAVQFTETFLTERDKQSKWSGIPQLLLKLHTTSHLHSDFVECQNILKLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALVSYIEEPYMDIDRDFTEE

SEQ ID NO: 67602 - protein, 789 aa, Homo sapiens
MAAAPVAAGSGAGRGRRSAATVAAWGGWGGRPRPGNILLQLRQGQLTGRGLVRAVQFTETFLTERDKQSKWSGIPQLLLKLHTTSHLHSDFVECQNILKEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALVSYIEEPYMDIDRDFTEE

SEQ ID NO: 67603 - protein, 399 aa, Homo sapiens
MRSQSTIKVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALVSYIEEPYMDIDRDFTEE

SEQ ID NO: 67604 - protein, 782 aa, Homo sapiens
MAAAPVAAGSGAGRGRRSAATVAAWGGWGQLTGRGLVRAVQFTETFLTERDKQSKWSGIPQLLLKLHTTSHLHSDFVECQNILKEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALVSYIEEPYMDIDRDFTEE

SEQ ID NO: 67605 - protein, 973 aa, Homo sapiens
MAQLYYKKVNYSPYRDRIPLQIVRAETELSAEEKAFLNAVEKGDYATVKQALQEAEIYYNVNINCMDPLGRSALLIAIENENLEIMELLLNHSVYVGDALLYAIRKEVVGAVELLLSYRRPSGEKQVPTLMMDTQFSEFTPDITPIMLAAHTNNYEIIKLLVQKRVTIPRPHQIRCNCVECVSSSEVDSLRHSRSRLNIYKALASPSLIALSSEDPILTAFRLGWELKELSKVENEFKAEYEELSQQCKLFAKDLLDQARSSRELEIILNHRDDHSEELDPQKYHDLAKLKVAIKYHQKEFVAQPNCQQLLATLWYDGFPGWRRKHWVVKLLTCMTIGFLFPMLSIAYLISPRSNLGLFIKKPFIKFICHTASYLTFLFMLLLASQHIVRTDLHVQGPPPTVVEWMILPWVLGFIWGEIKEMWDGGFTEYIHDWWNLMDFAMNSLYLATISLKIVAYVKYNGSRPREEWEMWHPTLIAEALFAISNILSSLRLISLFTANSHLGPLQISLGRMLLDILKFLFIYCLVLLAFANGLNQLYFYYETRAIDEPNNCKGIRCEKQNNAFSTLFETLQSLFWSVFGLLNLYVTNVKARHEFTEFVGATMFGTYNVISLVVLLNMLIAMMNNSYQLIADHADIEWKFARTKLWMSYFDEGGTLPPPFNIIPSPKSFLYLGNWFNNTFCPKRDPDGRRRRRNLRSFTERNADSLIQNQHYQEVIRNLVKRYVAAMIRNSKTHEGLTEENFKELKQDISSFRYEVLDLLGNRKHPRSFSTSSTELSQRDDNNDGSGGARAKSKSVSFNLGCKKKTCHGPPLIRTMPRSSGAQGKSKAESSSKRSFMGPSLKKLGLLFSKFNGHMSEPSSEPMYTISDGIVQQHCMWQDIRYSQMEKGKAEACSQSEINLSEVELGEVQGAAQSSECPLACSSSLHCASSICSSNSKLLDSSEDVFETWGEACDLLMHKWGDGQEEQVTTRL

SEQ ID NO: 67606 - protein, 931 aa, Homo sapiens
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKNDYKKLSMQCKDFVVGLLDLCRNTEEVEAILNGDVETLQSGDHGRPNLSRLKLAIKYEVKKFVAHPNCQQQLLSIWYENLSGLRQQTMAVKFLVVLAVAIGLPFLALIYWFAPCSKMGKIMRGPFMKFVAHAASFTIFLGLLVMNAADRFEGTKLLPNETSTDNAKQLFRMKTSCFSWMEMLIISWVIGMIWAECKEIWTQGPKEYLFELWNMLDFGMLAIFAASFIARFMAFWHASKAQSIIDANDTLKDLTKVTLGDNVKYYNLARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 67607 - protein, 815 aa, Homo sapiens
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKMGKIMRGPFMKFVAHAASFTIFLGLLVMNAADRFEGTKLLPNETSTDNAKQLFRMKTSCFSWMEMLIISWVIGMIWAECKEIWTQGPKEYLFELWNMLDFGMLAIFAASFIARFMAFWHASKAQSIIDANDTLKDLTKVTLGDNVKYYNLARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 67608 - protein, 876 aa, Homo sapiens
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKNDYKKLSMQCKDFVVGLLDLCRNTEEVEAILNGDVETLQSGDHGRPNLSRLKLAIKYEVKKMGKIMRGPFMKFVAHAASFTIFLGLLVMNAADRFEGTKLLPNETSTDNAKQLFRMKTSCFSWMEMLIISWVIGMIWAECKEIWTQGPKEYLFELWNMLDFGMLAIFAASFIARFMAFWHASKAQSIIDANDTLKDLTKVTLGDNVKYYNLARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 67609 - protein, 801 aa, Homo sapiens
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKFVAHPNCQQQLLTMWYENLSGLRQQSIAVKFLAVFGVSIGLPFLAIAYWIAPCSKLGRTLRSPFMKFVAHAVSFTIFLGLLVVNASDRFEGVKTLPNETFTDYPKQIFRVKTTQFSWTEMLIMKWVLGMIWSECKEIWEEGPREYVLHLWNLLDFGMLSIFVASFTARFMAFLKATEAQLYVDQHVQDDTLHNVSLPPEVAYFTYARDKWWPSDPQIISEGLYAIAVVLSFSRIAYILPANESFGPLQISLGRTVKDIFKFMVIFIMVFVAFMIGMFNLYSYYRGAKYNPAFTTVEESFKTLFWSIFGLSEVISVVLKYDHKFIENIGYVLYGVYNVTMVVVLLNMLIAMINNSYQEIEEDADVEWKFARAKLWLSYFDEGRTLPAPFNLVPSPKSFYYLIMRIKMCLIKLCKSKAKSCENDLEMGMLNSKFKKTRYQAGMRNSENLTANNTLSKPTRYQKIMKRLIKRYVLKAQVDRENDEVNEGELKEIKQDISSLRYELLEEKSQATGELADLIQQLSEKFGKNLNKDHLRVNKGKDI

SEQ ID NO: 67610 - protein, 746 aa, Homo sapiens
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKLGRTLRSPFMKFVAHAVSFTIFLGLLVVNASDRFEGVKTLPNETFTDYPKQIFRVKTTQFSWTEMLIMKWVLGMIWSECKEIWEEGPREYVLHLWNLLDFGMLSIFVASFTARFMAFLKATEAQLYVDQHVQDDTLHNVSLPPEVAYFTYARDKWWPSDPQIISEGLYAIAVVLSFSRIAYILPANESFGPLQISLGRTVKDIFKFMVIFIMVFVAFMIGMFNLYSYYRGAKYNPAFTTVEESFKTLFWSIFGLSEVISVVLKYDHKFIENIGYVLYGVYNVTMVVVLLNMLIAMINNSYQEIEEDADVEWKFARAKLWLSYFDEGRTLPAPFNLVPSPKSFYYLIMRIKMCLIKLCKSKAKSCENDLEMGMLNSKFKKTRYQAGMRNSENLTANNTLSKPTRYQKIMKRLIKRYVLKAQVDRENDEVNEGELKEIKQDISSLRYELLEEKSQATGELADLIQQLSEKFGKNLNKDHLRVNKGKDI

SEQ ID NO: 67611 - protein, 862 aa, Homo sapiens
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKNDYRKLSMQCKDFVVGVLDLCRDTEEVEAILNGDVNFQVWSDHHRPSLSRIKLAIKYEVKKFVAHPNCQQQLLTMWYENLSGLRQQSIAVKFLAVFGVSIGLPFLAIAYWIAPCSKLGRTLRSPFMKFVAHAVSFTIFLGLLVVNASDRFEGVKTLPNETFTDYPKQIFRVKTTQFSWTEMLIMKWVLGMIWSECKEIWEEGPREYVLHLWNLLDFGMLSIFVASFTARFMAFLKATEAQLYVDQHVQDDTLHNVSLPPEVAYFTYARDKWWPSDPQIISEGLYAIAVVLSFSRIAYILPANESFGPLQISLGRTVKDIFKFMVIFIMVFVAFMIGMFNLYSYYRGAKYNPAFTTVEESFKTLFWSIFGLSEVISVVLKYDHKFIENIGYVLYGVYNVTMVVVLLNMLIAMINNSYQEIEEDADVEWKFARAKLWLSYFDEGRTLPAPFNLVPSPKSFYYLIMRIKMCLIKLCKSKAKSCENDLEMGMLNSKFKKTRYQAGMRNSENLTANNTLSKPTRYQKIMKRLIKRYVLKAQVDRENDEVNEGELKEIKQDISSLRYELLEEKSQATGELADLIQQLSEKFGKNLNKDHLRVNKGKDI

SEQ ID NO: 67612 - protein, 1449 aa, Homo sapiens
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTAQALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGENPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 67613 - protein, 1503 aa, Homo sapiens
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQKVLVEDPERPACAPAAPRLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTAQALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGDTLEPLSTIQYNVVDGLRDRRSFHGPYTVQAGLPLNPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 67614 - protein, 1503 aa, Homo sapiens; identical to SEQ ID NO: 67613

SEQ ID NO: 67615 - protein, 144 aa, Homo sapiens
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVR

SEQ ID NO: 67616 - protein, 247 aa, Homo sapiens [sequence omitted]

SEQ ID NO: 67617 - protein, 1711 aa, Homo sapiens
MGKKWRDAAEMERGCSDREDNAESRRRSRSASRGRFAESWKRLSSKQGSTKRSGLPSQQTPAQKSWIERAFYKRECVHIIPSTKDPHRCCCGRLIGQHVGLTPSISVLQNEKNESRLSRNDIQSEKWSISKHTQLSPTDAFGTIEFQGGGHSNKAMYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKREYPGFGWIYFKGNLPPDYRISLIDIGLVIEYLMGGAYRCNYTRKRFRTLYHNLFGPKRDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 67618 - protein, 1569 aa, Homo sapiens
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRCLPFFSLDSRLFYSFWGSCQLDSVGIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKGNLPPDYRISLIDIGLVIEYLMGGAYRCNYTRKRFRTLYHNLFGPKRDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 67619 - protein, 1569 aa, Homo sapiens; identical to SEQ ID NO: 67618

SEQ ID NO: 67620 - protein, 1566 aa, Homo sapiens
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKREYPGFGWIYFKGNLPPDYRISLIDIGLVIEYLMGGAYRCNYTRKRFRTLYHNLFGPKRPKALKLLGMEDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 67621 - protein, 1579 aa, Homo sapiens
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRCLPFFSLDSRLFYSFWGSCQLDSVGIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKGNLPPDYRISLIDIGLVIEYLMGGAYRCNYTRKRFRTLYHNLFGPKRPKALKLLGMEDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 67622 - protein, 1707 aa, Homo sapiens
MPEPWGTVYFLGIAQVFSFLFSWWNLEGVMNQADAPRPLNWTIRKLCHAAFLPSVRLLKAQKSWIERAFYKRECVHIIPSTKDPHRCCCGRLIGQHVGLTPSISVLQNEKNESRLSRNDIQSEKWSISKHTQLSPTDAFGTIEFQGGGHSNKAMYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKGNLPPDYRISLIDIGLVIEYLMGGAYRCNYTRKRFRTLYHNLFGPKRPKALKLLGMEDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 67623 - protein, 1325 aa, Homo sapiens
MPEPWGTVYFLGIAQVFSFLFSWWNLEGVMNQADAPRPLNWTIRKLCHAAFLPSVRLLKAQKSWIERAFYKRECVHIIPSTKDPHRCCCGRLIGQHVGLTPSISVLQNEKNESRLSRNDIQSEKWSISKHTQLSPTDAFGTIEFQGGGHSNKAMYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKGNLPPDYRISLIDIGLVIEYLMGGAYRCNYTRKRFRTLYHNLFGPKRPKALKLLGMEDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAEHPLYSV

SEQ ID NO: 67624 - protein, 1556 aa, Homo sapiens
  MOD_RES (1)..(1): Any amino acid
XYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKREYPGFGWIYFKGNLPPDYRISLIDIGLVIEYLMGGAYRCNYTRKRFRTLYHNLFGPKRDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 67625 - protein, 1566 aa, Homo sapiens
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKGNLPPDYRISLIDIGLVIEYLMGGAYRCNYTRKRFRTLYHNLFGPKRPKALKLLGMEDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDRKQVYDSHTPKSAPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 67626 - protein, 1579 aa, Homo sapiens; identical to SEQ ID NO: 67621

SEQ ID NO: 67627 - protein, 1566 aa, Homo sapiens; identical to SEQ ID NO: 67620

SEQ ID NO: 67628 - protein, 1734 aa, Homo sapiens
MGKKWRDAAEMERGCSDREDNAESRRRSRSASRGRFAESWKRLSSKQGSTKRSGLPSQQTPAQKSWIERAFYKRECVHIIPSTKDPHRCCCGRLIGQHVGLTPSISVLQNEKNESRLSRNDIQSEKWSISKHTQLSPTDAFGTIEFQGGGHSNKAMYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRCLPFFSLDSRLFYSFWGSCQLDSVGIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKGNLPPDYRISLIDIGLVIEYLMGGAYRCNYTRKRFRTLYHNLFGPKRPKALKLLGMEDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 67629 - protein, 214 aa, Homo sapiens
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTSFHSYKTAHVDLQDKRQVKTALEQAEWQPGRGMFDHDNLMQST

SEQ ID NO: 67630 - protein, 1214 aa, Homo sapiens
MVVPEKEQSWIPKIFKKKTCTTFIVDSTDPGGTLCQCGRPRTAHPAVAMEDAFGAAVVTVWDSDAHTTEKPTDAYGELDFTGAGRKHSNFLRLSDRTDPAAVYSLVTRTWGFRAPNLVVSVLGGSGGPVLQTWLQDLLRRGLVRAAQSTGAWIVTGGLHTGIGRHVGVAVRDHQMASTGGTKVVAMGVAPWGVVRNRDTLINPKGSFPARYRWRGDPEDGVQFPLDYNYSAFFLVDDGTHGCLGGENRFRLRLESYISQQKTGVGGTGIDIPVLLLLIDGDEKMLTRIENATQAQLPCLLVAGSGGAADCLAETLEDTLAPGSGGARQGEARDRIRRFFPKGDLEVLQAQVERIMTRKELLTVYSSEDGSEEFETIVLKALVKACGSSEASAYLDELRLAVAWNRVDIAQSELFRGDIQWRSFHLEASLMDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGTADPAEKTPLGVPRQSGRPGCCGGRCGGRRCLRRWFHFWGAPVTIFMGNVVSYLLFLLLFSRVLLVDFQPAPPGSLELLLYFWAFTLLCEELRQGLSGGGGSLASGGPGPGHASLSQRLRLYLADSWNQCDLVALTCFLLGVGCRLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 67631 - protein, 860 aa, Homo sapiens
MLTRIENATQAQLPCLLVAGSGGAADCLAETLEDTLAPGSGGARQGEARDRIRRFFPKGDLEVLQAQSFHLEASLMDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGTADPAEKTPLGVPRQSGRPGCCGGRCGGRRCLRRWFHFWGAPVTIFMGNVVSYLLFLLLFSRVLLVDFQPAPPGSLELLLYFWAFTLLCEELRQGLSGGGGSLASGGPGPGHASLSQRLRLYLADSWNQCDLVALTCFLLGVGCRLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 67632 - protein, 1069 aa, Homo sapiens
MVVPEKEQSWIPKIFKKKTCTTFIVDSTDPGGTLCQCGRPRTAHPAVAMEDAFGAAVVTVWDSDAHTTEKPTDAYGELDFTGAGRKHSNFLRLSDRTDPAAVYSLVTRTWGFRAPNLVVSVLGGSGGPVLQTWLQDLLRRGLVRAAQSTGAWIVTGGLHTGIGRHVGVAVRDHQMASTGGTKVVAMGVAPWGVVRNRDTLINPKGSFPARYRWRGDPEDGVQFPLDYNYSAFFLVDDGTHGCLGGENRFRLRLESYISQQKTGVGGTGIDIPVLLLLIDGDEKMLTRIENATQAQLPCLLVAGSGGAADCLAETLEDTLAPGSGGARQGEARDRIRRFFPKGDLEVLQAQVERIMTRKELLTVYSSEDGSEEFETIVLKALVKACGSSEASAYLDELRLAVAWNRVDIAQSELFRGDIQWRSFHLEASLMDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 67633 - protein, 1165 aa, Homo sapiens
MQDVQGPRPGSPGDAEDRRELGLHRGEVNFGGSGKKRGKFVRVPSGVAPSVLFDLLLAEWHLPAPNLVVSLVGEEQPFAMKSWLRDVLRKGLVKAAQSTGAWILTSALRVGLARHVGQAVRDHSLASTSTKVRVVAVGMASLGRVLHRRILEEAQEDFPVHYPEDDGGSQGPLCSLDSNLSHFILVEPGPPGKGDGLTELRLRLEKHISEQRAGYGGTGSIEIPVLCLLVNGDPNTLERISRAVEQAAPWLILVGSGGIADVLAALVNQPHLLVPKVAEKQFKEKFPSKHFSWEDIVRWTKLLQNITSHQHLLTVYDFEQEGSEELDTVILKALVKACKSHSQEPQDYLDELKLAVAWDRVDIAKSEIFNGDVEWKSCDLEEVMVDALVSNKPEFVRLFVDNGADVADFLTYGRLQELYRSVSRKSLLFDLLQRKQEEARLTLAGLGTQQAREPPAGPPAFSLHEVSRVLKDFLQDACRGFYQDGRPGDRRRAEKGPAKRPTGQKWLLDLNQKSENPWRDLFLWAVLQNRHEMATYFWAMGQEGVAAALAACKILKEMSHLETEAEAARATREAKYERLALDLFSECYSNSEARAFALLVRRNRCWSKTTCLHLATEADAKAFFAHDGVQAFLTRIWWGDMAAGTPILRLLGAFLCPALVYTNLITFSEEAPLRTGLEDLQDLDSLDTEKSPLYGLQSRVEELVEAPRAQGDRGPRAVFLLTRWRKFWGAPVTVFLGNVVMYFAFLFLFTYVLLVDFRPPPQGPSGPEVTLYFWVFTLVLEEIRQGFFTDEDTHLVKKFTLYVGDNWNKCDMVAIFLFIVGVTCRMLPSAFEAGRTVLAMDFMVFTLRLIHIFAIHKQLGPKIIVVERMMKDVFFFLFFLSVWLVAYGVTTQALLHPHDGRLEWIFRRVLYRPYLQIFGQIPLDEIDEARVNCSTHPLLLEDSPSCPSLYANWLVILLLVTFLLVTNVLLMNLLIAMFSYTFQVVQGNADMFWKFQRYNLIVEYHERPALAPPFILLSHLSLTLRRVFKKEAEHKREHLERDLPDPLDQKVVTWETVQKENFLSKMEKRRRDSEGEVLRKTAHRVDFIAKYLGGLREQEKRIKCLESQINYCSVLVSSVADVLAQGGGPRSSQHCGEGSQLVAADHRGGLDGWEQPGAGQPPSDT

SEQ ID NO: 67634 - protein, 872 aa, Homo sapiens
MQDVQGPRPGSPGDAEDRRELGLHRGEVNFGGSGKKRGKFVRVPSGVAPSVLFDLLLAEWHLPAPNLVVSLVGEEQPFAMKSWLRDVLRKGLVKAAQSTGAWILTSALRVGLARHVGQAVRDHSLASTSTKVRVVAVGMASLGRVLHRRILEEAQEDFPVHYPEDDGGSQGPLCSLDSNLSHFILVEPGPPGKGDGLTELRLRLEKHISEQRAGYGGTGSIEIPVLCLLVNGDPNTLERISRAVEQAAPWLILVGSGGIADVLAALVNQPHLLVPKVAEKQFKEKFPSKHFSWEDIVRWTKLLQNITSHQHLLTVYDFEQEGSEELDTVILKALVKACKSHSQEPQDYLDELKLAVAWDRVDIAKSEIFNGDVEWKSCDLEEVMVDALVSNKPEFVRLFVDNGADVADFLTYGRLQELYRSVSRKSLLFDLLQRKQEEARLTLAGLGTQQAREPPAGPPAFSLHEVSRVLKDFLQDACRGFYQDGRPGDRRRAEKGPAKRPTGQKWLLDLNQKSENPWRDLFLWAVLQNRHEMATYFWAMGQEGVAAALAACKILKEMSHLETEAEAARATREAKYERLALDLFSECYSNSEARAFALLVRRNRCWSKTTCLHLATEADAKAFFAHDGVQAFLTRIWWGDMAAGTPILRLLGAFLCPALVYTNLITFSEEAPLRTGLEDLQDLDSLDTEKSPLYGLQSRVEELVEAPRAQGDRGPRAVFLLTRWRKFWGAPVTVFLGNVVMYFAFLFLFTYVLLVDFRPPPQGPSGPEVTLYFWVFTLVLEEIRQGFFTDEDTHLVKKFTLYVGDNWNKCDMVAIFLFIVGVTCRMLPSAFEAGRTVLAMDFMVFTLRLIHIFAIHKQLGPKIIVVERMKPV

SEQ ID NO: 67635 - protein, 1167 aa, Homo sapiens
MQDVQGPRPGSPGDAEDRRELGLHRGEVNFGGSGKKRGKFVRVPSGVAPSVLFDLLLAEWHLPAPNLVVSLVGEEQPFAMKSWLRDVLRKGLVKAAQSTGAWILTSALRVGLARHVGQAVRDHSLASTSTKVRVVAVGMASLGRVLHRRILEEAQVHEDFPVHYPEDDGGSQGPLCSLDSNLSHFILVEPGPPGKGDGLTELRLRLEKHISEQRAGYGGTGSIEIPVLCLLVNGDPNTLERISRAVEQAAPWLILVGSGGIADVLAALVNQPHLLVPKVAEKQFKEKFPSKHFSWEDIVRWTKLLQNITSHQHLLTVYDFEQEGSEELDTVILKALVKACKSHSQEPQDYLDELKLAVAWDRVDIAKSEIFNGDVEWKSCDLEEVMVDALVSNKPEFVRLFVDNGADVADFLTYGRLQELYRSVSRKSLLFDLLQRKQEEARLTLAGLGTQQAREPPAGPPAFSLHEVSRVLKDFLQDACRGFYQDGRPGDRRRAEKGPAKRPTGQKWLLDLNQKSENPWRDLFLWAVLQNRHEMATYFWAMGQEGVAAALAACKILKEMSHLETEAEAARATREAKYERLALDLFSECYSNSEARAFALLVRRNRCWSKTTCLHLATEADAKAFFAHDGVQAFLTRIWWGDMAAGTPILRLLGAFLCPALVYTNLITFSEEAPLRTGLEDLQDLDSLDTEKSPLYGLQSRVEELVEAPRAQGDRGPRAVFLLTRWRKFWGAPVTVFLGNVVMYFAFLFLFTYVLLVDFRPPPQGPSGPEVTLYFWVFTLVLEEIRQGFFTDEDTHLVKKFTLYVGDNWNKCDMVAIFLFIVGVTCRMLPSAFEAGRTVLAMDFMVFTLRLIHIFAIHKQLGPKIIVVERMMKDVFFFLFFLSVWLVAYGVTTQALLHPHDGRLEWIFRRVLYRPYLQIFGQIPLDEIDEARVNCSTHPLLLEDSPSCPSLYANWLVILLLVTFLLVTNVLLMNLLIAMFSYTFQVVQGNADMFWKFQRYNLIVEYHERPALAPPFILLSHLSLTLRRVFKKEAEHKREHLERDLPDPLDQKVVTWETVQKENFLSKMEKRRRDSEGEVLRKTAHRVDFIAKYLGGLREQEKRIKCLESQINYCSVLVSSVADVLAQGGGPRSSQHCGEGSQLVAADHRGGLDGWEQPGAGQPPSDT

SEQ ID NO: 67636 - protein, 1159 aa, Homo sapiens
PGSPGDAEDRRELGLHRGEVNFGGSGKKRGKFVRVPSGVAPSVLFDLLLAEWHLPAPNLVVSLVGEEQPFAMKSWLRDVLRKGLVKAAQSTGAWILTSALRVGLARHVGQAVRDHSLASTSTKVRVVAVGMASLGRVLHRRILEEAQVHEDFPVHYPEDDGGSQGPLCSLDSNLSHFILVEPGPPGKGDGLTELRLRLEKHISEQRAGYGGTGSIEIPVLCLLVNGDPNTLERISRAVEQAAPWLILVGSGGIADVLAALVNQPHLLVPKVAEKQFKEKFPSKHFSWEDIVRWTKLLQNITSHQHLLTVYDFEQEGSEELDTVILKALVKACKSHSQEPQDYLDELKLAVAWDRVDIAKSEIFNGDVEWKSCDLEEVMVDALVSNKPEFVRLFVDNGADVADFLTYGRLQELYRSVSRKSLLFDLLQRKQEEARLTLAGLGTQQAREPPAGPPAFSLHEVSRVLKDFLQDACRGFYQDGRPGDRRRAEKGPAKRPTGQKWLLDLNQKSENPWRDLFLWAVLQNRHEMATYFWAMGQEGVAAALAACKILKEMSHLETEAEAARATREAKYERLALDLFSECYSNSEARAFALLVRRNRCWSKTTCLHLATEADAKAFFAHDGVQAFLTRIWWGDMAAGTPILRLLGAFLCPALVYTNLITFSEEAPLRTGLEDLQDLDSLDTEKSPLYGLQSRVEELVEAPRAQGDRGPRAVFLLTRWRKFWGAPVTVFLGNVVMYFAFLFLFTYVLLVDFRPPPQGPSGPEVTLYFWVFTLVLEEIRQGFFTDEDTHLVKKFTLYVGDNWNKCDMVAIFLFIVGVTCRMLPSAFEAGRTVLAMDFMVFTLRLIHIFAIHKQLGPKIIVVERMMKDVFFFLFFLSVWLVAYGVTTQALLHPHDGRLEWIFRRVLYRPYLQIFGQIPLDEIDEARVNCSTHPLLLEDSPSCPSLYANWLVILLLVTFLLVTNVLLMNLLIAMFSYTFQVVQGNADMFWKFQRYNLIVEYHERPALAPPFILLSHLSLTLRRVFKKEAEHKREHLERDLPDPLDQKVVTWETVQKENFLSKMEKRRRDSEGEVLRKTAHRVDFIAKYLGGLREQEKRIKCLESQINYCSVLVSSVADVLAQGGGPRSSQHCGEGSQLVAADHRGGLDGWEQPGAGQPPSDT

SEQ ID NO: 67637 - protein, 1133 aa, Homo sapiens
MLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLRRYRPFARSHSFRFHKEEKLMKICKIKSKE

SEQ ID NO: 67638 - protein, 303 aa, Homo sapiens
MKEQPVLERLQSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCREYHRGSVTQSGCRPAEVFHGLP

SEQ ID NO: 67639 - protein, 2022 aa, Homo sapiens
MKEQPVLERLQSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLSQAKIMQTGGGYVNWAFSEGDETGVFSIKKKWQTCLPSTCDSDSSRSEQHQKQAQDSSLSDNSTRSAQSSECSEVGPWLQPNTSFWINPLRRYRPFARSHSFRFHKEEKLMKICKIKNLSGSSEIGQGAWVKAKMLTKDRRLSKKKKNTQGLQVPIITVNACSQSDQLNPEPGENSISEEEYSKNWFTVSKFSHTGVEPYIHQKMKTKEIGQCAIQISDYLKQSQEDLSKNSLWNSRSTNLNRNSLLKSSIGVDKISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 67640 - protein, 2017 aa, Homo sapiens
MTAPVTSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLSQAKIMQTGGGYVNWAFSEGDETGVFSIKKKWQTCLPSTCDSDSSRSEQHQKQAQDSSLSDNSTRSAQSSECSEVGPWLQPNTSFWINPLRRYRPFARSHSFRFHKEEKLMKICKIKNLSGSSEIGQGAWVKAKMLTKDRRLSKKKKNTQGLQVPIITVNACSQSDQLNPEPGENSISEEEYSKNWFTVSKFSHTGVEPYIHQKMKTKEIGQCAIQISDYLKQSQEDLSKNSLWNSRSTNLNRNSLLKSSIGVDKISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 67641 - protein, 1947 aa, Homo sapiens
MKEQPVLERLQSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLSQAKIMQTGGGYVNWAFSEGDETGVFSIKKKWQTCLPSTCDSDSSRSEQHQKQAQDSSLSDNSTRSAQSSECSEVGPWLQPNTSFWINPLRRYRPFARSHSFRFHKEEKLMKICKIKNLSGSSEIGQGAWVKAKMLTKDRRLSKKKKNTQGLQVPIITVNACSQSDQLNPEPGENSISEEEYSKNWFTVSKFSHTGVEPYIHQKMKTKEIGQCAIQISDYLKQSQEDLSKNSLWNSRSTNLNRNSLHVIKMPISSLISEISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQALWFWDSMLKARLGGWRM

SEQ ID NO: 67642 - protein, 568 aa, Homo sapiens
RESPHPALLQSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCPGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 67643 - protein, 859 aa, Homo sapiens
MKEQPVLERLQSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQDLSKNSLWNSRSTNLNRNSLHVIKMPISSLISEISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 67644 - protein, 977 aa, Homo sapiens
MKEQPVLERLQSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKIITVNACSQSDQLNPEPGENSISEEEYSKNWFTVSKFSHTGVEPYIHQKMKTKEIGQCAIQISDYLKQSQEDLSKNSLWNSRSTNLNRNSLHVIKMPISSLISEISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 67645 - protein, 1133 aa, Homo sapiens
MLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLSRYRPFARSHSFRFHKEEKLMKICKIKSKE

SEQ ID NO: 67646 - protein, 2017 aa, Homo sapiens
MIILSKSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLSQAKIMQTGGGYVNWAFSEGDETGVFSIKKKWQTCLPSTCDSDSSRSEQHQKQAQDSSLSDNSTRSAQSSECSEVGPWLQPNTSFWINPLRRYRPFARSHSFRFHKEEKLMKICKIKNLSGSSEIGQGAWVKAKMLTKDRRLSKKKKNTQGLQVPIITVNACSQSDQLNPEPGENSISEEEYSKNWFTVSKFSHTGVEPYIHQKMKTKEIGQCAIQISDYLKQSQEDLSKNSLWNSRSTNLNRNSLLKSSIGVDKISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 67647 - protein, 2026 aa, Homo sapiens
MKEQPVLERLQSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLSQAKIMQTGGGYVNWAFSEGDETGVFSIKKKWQTCLPSTCDSDSSRSEQHQKQAQDSSLSDNSTRSAQSSECSEVGPWLQPNTSFWINPLRRYRPFARSHSFRFHKEEKLMKICKIKNLSGSSEIGQGAWVKAKMLTKDRRLSKKKKNTQGLQVPIITVNACSQSDQLNPEPGENSISEEEYSKNWFTVSKFSHTGVEPYIHQKMKTKEIGQCAIQISDYLKQSQEDLSKNSLWNSRSTNLNRNSLHVIKMPISSLISEISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 67648 - protein, 1865 aa, Homo sapiens
MSQKSWIESTLTKRECVYIIPSSKDPHRCLPGCQICQQLVRCFCGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRRELEKTINQQRIHARIGQGVPVVALIFEGGPNVILTVLEYLQESPPVPVVVCEGTGRAADLLAYIHKQTEEGGNLPDAAEPDIISTIKKTFNFGQNEALHLFQTLMECMKRKELITVFHIGSDEHQDIDVAILTALLKGTNASAFDQLILTLAWDRVDIAKNHVFVYGQQWLVGSLEQAMLDALVMDRVAFVKLLIENGVSMHKFLTIPRLEELYNTKQGPTNPMLFHLVRDVKQGNLPPGYKITLIDIGLVIEYLMGGTYRCTYTRKRFRLIYNSLGGNNRRSGRNTSSSTPQLRKSHESFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVANMFYIVVIMALVLLSFGVPRKAILYPHEAPSWTLAKDIVFHPYWMIFGEVYAYEIDVCANDSVIPQICGPGTWLTPFLQAVYLFVQYIIMVNLLIAFFNNVYLQVKAISNIVWKYQRYHFIMAYHEKPVLPPPLIILSHIVSLFCCICKRRKKDKTSDGPKLFLTEEDQKKLHDFEEQCVEMYFNEKDDKFHSGSEERIRVTFERVEQMCIQIKEVGDRVNYIKRSLQSLDSQIGHLQDLSALTVDTLKTLTAQKASEASKVHNEITRELSISKHLAQNLIDDGPVRPSVWKKHGVVNTLSSSLPQGDLESNNPFHCNILMKDDKDPQCNIFGQDLPAVPQRKEFNFPEAGSSSGALFPSAVSPPELRQRLHGVELLKIFNKNQKLGSSSTSIPHLSSPPTKFFVSTPSQPSCKSHLETGTKDQETVCSKATEGDNTEFGAFVGHRDSMDLQRFKETSNKIKILSNNNTSENTLKRVSSLAGFTDCHRTSIPVHSKQAEKISRRPSTEDTHEVDSKAALIPDWLQDRPSNREMPSEEGTLNGLTSPFKPAMDTNYYYSAVERNNLMRLSQSIPFTPVPPRGEPVTVYRLEESSPNILNNSMSSWSQLGLCAKIEFLSKEEMGGGLRRAVKVQCTWSEHDILKSGHLYIIKSFLPEVVNTWSSIYKEDTVLHLCLREIQQQRAAQKLTFAFNQMKPKSIPYSPRFLEVFLLYCHSAGQWFAVEECMTGEFRKYNNNNGDEIIPTNTLEEIMLAFSHWTYEYTRGELLVLDLQGVGENLTDPSVIKAEEKRSCDMVFGPANLGEDAIKNFRAKHHCNSCCRKLKLPDLKRNDYTPDKIIFPQDEPSDLNLQPGNSTKESESTNSVRLML

SEQ ID NO: 67649 - protein, 1104 aa, Homo sapiens
MSFRAARLSMRNRRNDTLDSTRTLYSSASRSTDLSYSESDLVNFIQANFKKRECVFFTKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEGYFLAQYLMDDFTRDPLYILDNNHTHLLLVDNGCHGHPTVEAKLRNQLEKYISERTIQDSNYGGKIPIVCFAQGGGKETLKAINTSIKNKIPCVVVEGSGQIADVIASLVEVEDALTSSAVKEKLVRFLPRTVSRLPEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQNFLSKQWYGEISRDTKNWKIILCLFIIPLVGCGFVSFRKKPVDKHKKLLWYYVAFFTSPFVVFSWNVVFYIAFLLLFAYVLLMDFHSVPHPPELVLYSLVFVLFCDEVRQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 67650 - protein, 192 aa, Homo sapiens
MKSFLPVHTIVLIRENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEVPVGQEEVC

SEQ ID NO: 67651 - protein, 165 aa, Homo sapiens
MEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEVPVGQEEVC

SEQ ID NO: 67652 - protein, 682 aa, Homo sapiens
MQAINTSIKNKIPCVVVEGSGQIADVIASLVEVEDALTSSAVKEKLVRFLPRTVSRLPEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 67653 - protein, 837 aa, Homo sapiens
METLTPGHLQPSPSSPRPRAAPGSLGRVTRRRLSRWIALTRKVSWTPARPSQSALLSPSRGQETAPPVPGCCPRTLSPPAPRRPSGSMIAGVSLKPLLRITARIWRACCSSCRRARSTSQTTSSKVAPALGSGRAPALACPDPPLCLSDPETGKTCLLKAMLNLHDGQNTTIPLLLEIARQTDSLKELVNASYTDSYYKGQTALHIAIERRNMALVTLLVENGADVQAAAHGDFFKKTKGRPGFYFGELPLSLAACTNQLGIVKFLLQNSWQTADISARDSVGNTVLHALVEVADNTADNTKFVTSMYNEILMLGAKLHPTLKLEELTNKKGMTPLALAAGTGKIGVLAYILQREIQEPECRHLSRKFTEWAYGPVHSSLYDLSCIDTCEKNSVLEVIAYSSSETPNRHDMLLVEPLNRLLQDKWDRFVKRIFYFNFLVYCLYMIIFTMAAYYRPVDGLPPFKMEKTGDYFRVTGEILSVLGGVYFFFRGIQYFLQRRPSMKTLFVDSYSEMLFFLQSLFMLATVVLYFSHLKEYVASMVFSLALGWTNMLYYTRGFQQMGIYAVMIEKMILRDLCRFMFVYIVFLFGFSTAVVTLIEDGKNDSLPSESTSHRWRGPACRPPDSSYNSLYSTCLELFKFTIGMGDLEFTENYDFKAVFIILLLAYVILTYILLLNMLIALMGETVNKIAQESKNIWKLQRAITILDTEKSFLKCMRKAFRSGKLLQVGYTPDGKDDYRWCFRVDEVNWTTWNTNVGIINEDPGNCEGVKRTLSFSLRSSRVSGRHWKNFALVPLLREASARDRQSAQPEEVYLRQFSGSLKPEDAEVFKSPAASGEK

SEQ ID NO: 67654 - protein, 779 aa, Homo sapiens
MKKWSSTDLGAAADPLQKDTCPDPLDGDPNSRPPPAKPQLSTAKSRTRLFGKGDSEEAFPVDCPHEEGELDSCPTITVSPVITIQRPGDGPTGARLLSQDSVAASTEKTLRLYDRRSIFEAVAQNNCQDLESLLLFLQKSKKHLTDNEFKDPETGKTCLLKAMLNLHDGQNTTIPLLLEIARQTDSLKELVNASYTDSYYKGQTALHIAIERRNMALVTLLVENGADVQAAAHGDFFKKTKGRPGFYFGELPLSLAACTNQLGIVKFLLQNSWQTADISARDSVGNTVLHALVEVADNTADNTKFVTSMYNEILMLGAKLHPTLKLEELTNKKGMTPLALAAGTGKIGNRHDMLLVEPLNRLLQDKWDRFVKRIFYFNFLVYCLYMIIFTMAAYYRPVDGLPPFKMEKTGDYFRVTGEILSVLGGVYFFFRGIQYFLQRRPSMKTLFVDSYSEMLFFLQSLFMLATVVLYFSHLKEYVASMVFSLALGWTNMLYYTRGFQQMGIYAVMIEKMILRDLCRFMFVYIVFLFGFSTAVVTLIEDGKNDSLPSESTSHRWRGPACRPPDSSYNSLYSTCLELFKFTIGMGDLEFTENYDFKAVFIILLLAYVILTYILLLNMLIALMGETVNKIAQESKNIWKLQRAITILDTEKSFLKCMRKAFRSGKLLQVGYTPDGKDDYRWCFRVDEVNWTTWNTNVGIINEDPGNCEGVKRTLSFSLRSSRVSGRHWKNFALVPLLREASARDRQSAQPEEVYLRQFSGSLKPEDAEVFKSPAASGEK

SEQ ID NO: 67655 - protein, 839 aa, Homo sapiens [sequence omitted]

SEQ ID NO: 67656 - protein, 839 aa, Homo sapiens [sequence omitted]

SEQ ID NO: 67657 - protein, 850 aa, Homo sapiens
MKKWSSTDLGAAADPLQKDTCPDPLDGDPNSRPPPAKPQLSTAKSRTRLFGKGDSEEAFPVDCPHEEGELDSCPTITVSPVITIQRPGDGPTGARLLSQDSVAASTEKTLRLYDRRSIFEAVAQNNCQDLESLLLFLQKSKKHLTDNEFKDPETGKTCLLKAMLNLHDGQNTTIPLLLEIARQTDSLKELVNASYTDSYYKGQTALHIAIERRNMALVTLLVENGADVQAAAHGDFFKKTKGRPGFYFGELPLSLAACTNQLGIVKFLLQNSWQTADISARDSVGNTVLHALVEVADNTADNTKFVTSMYNEILMLGAKLHPTLKLEELTNKKGMTPLALAAGTGKIGVIENGPPLSFMVLAYILQREIQEPECRHLSRKFTEWAYGPVHSSLYDLSCIDTCEKNSVLEVIAYSSSETPNRHDMLLVEPLNRLLQDKWDRFVKRIFYFNFLVYCLYMIIFTMAAYYRPVDGLPPFKMEKTGDYFRVTGEILSVLGGVYFFFRGIQYFLQRRPSMKTLFVDSYSEMLFFLQSLFMLATVVLYFSHLKEYVASMVFSLALGWTNMLYYTRGFQQMGIYAVMIEKMILRDLCRFMFVYIVFLFGFSTAVVTLIEDGKNDSLPSESTSHRWRGPACRPPDSSYNSLYSTCLELFKFTIGMGDLEFTENYDFKAVFIILLLAYVILTYILLLNMLIALMGETVNKIAQESKNIWKLQRAITILDTEKSFLKCMRKAFRSGKLLQVGYTPDGKDDYRWCFRVDEVNWTTWNTNVGIINEDPGNCEGVKRTLSFSLRSSRVSGRHWKNFALVPLLREASARDRQSAQPEEVYLRQFSGSLKPEDAEVFKSPAASGEK

SEQ ID NO: 67658 - protein, 764 aa, Homo sapiens
MTSPSSSPVFRLETLDGGQEDGSEADRGKLDFGSGLPPMESQFQGEDRKFAPQIRVNLNYRKGTGASQPDPNRFDRDRLFNAVSRGVPEDLAGLPEYLSKTSKYLTDSEYTEGSTGKTCLMKAVLNLKDGVNACILPLLQIDRDSGNPQPLVNAQCTDDYYRGHSALHIAIEKRSLQCVKLLVENGANVHARACGRFFQKGQGTCFYFGELPLSLAACTKQWDVVSYLLENPHQPASLQATDSQGNTVLHALVMISDNSAENIALVTSMYDGLLQAGARLCPTVQLEDIRNLQDLTPLKLAAKEGKIEIFRHILQREFSGLSHLSRKFTEWCYGPVRVSLYDLASVDSCEENSVLEIIAFHCKSPHRHRMVVLEPLNKLLQAKWDLLIPKFFLNFLCNLIYMFIFTAVAYHQPTLKKQAAPHLKAEVGNSMLLTGHILILLGGIYLLVGQLWYFWRRHVFIWISFIDSYFEILFLFQALLTVVSQVLCFLAIEWYLPLLVSALVLGWLNLLYYTRGFQHTGIYSVMIQKVILRDLLRFLLIYLVFLFGFAVALVSLSQEAWRPEAPTGPNATESVQPMEGQEDEGNGAQYRGILEASLELFKFTIGMGELAFQEQLHFRGMVLLLLLAYVLLTYILLLNMLIALMSETVNSVATDSWSIWKLQKAISVLEMENGYWWCRKKQRAGVMLTVGTKPDGSPDERWCFRVEEVNWASWEQTLPTLCEDPSGAGVPRTLENPVLASPPKEDEDGASEENYVPVQLLQSN

SEQ ID NO: 67659 - protein, 266 aa, Homo sapiens
  MOD_RES (1)..(1): Any amino acid
XDFSLGVPSWWCLICFNIGPSVGPSQPDPNRFDRDRLFNAVSRGVPEDLAGLPEYLSKTSKYLTDSEYTEGSTGKTCLMKAVLNLKDGVNACILPLLQIDRDSGNPQPLVNAQCTDDYYRGHSALHIAIEKRSLQCVKLLVENGANVHARACGRFFQKGQGTCFYFGELPLSLAACTKQWDVVSYLLENPHQPASLQATDSQGNTVLHALVMISDNSAENIALVTSMYDGLLQAGARLCPTVQLEDIRNLQDLTPLKLAAKEGKIE

SEQ ID NO: 67660 - protein, 790 aa, Homo sapiens; identical to SEQ ID NO: 67586

SEQ ID NO: 67661 - protein, 791 aa, Homo sapiens
MKAHPKEMVPLMGKRVAAPSGNPAILPEKRPAEITPTKKSAHFFLEIEGFEPNPTVAKTSPPVFSKPMDSNIRQCISGNCDDMDSPQSPQDDVTETPSNPNSPSAQLAKEEQRRKKRRLKKRIFAAVSEGCVEELVELLVELQELCRRRHDEDVPDFLMHKLTASDTGKTCLMKALLNINPNTKEIVRILLAFAEENDILGRFINAEYTEEAYEGQTALNIAIERRQGDIAALLIAAGADVNAHAKGAFFNPKYQHEGFYFGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFFIQAVLVILSVFLYLFAYKEYLACLVLAMALGWANMLYYTRGFQSMGMYSVMIQKVILHDVLKFLFVYIVFLLGFGVALASLIEKCPKDNKDCSSYGSFSDAVLELFKLTIGLGDLNIQQNSKYPILFLFLLITYVILTFVLLLNMLIALMGETVENVSKESERIWRLQRARTILEFEKMLPEWLRSRFRMGELCKVAEDDFRLCLRINEVKWTEWKTHVSFLNEDPGPVRRTADFNKIQDSSRNNSKTTLNAFEEVEEFPETSV

SEQ ID NO: 67662 - protein, 775 aa, Homo sapiens
MSHHTWPSPALNLDFATYLLRDLGAHFFLEIEGFEPNPTVAKTSPPVFSKPMDSNIRQCISGNCDDMDSPQSPQDDVTETPSNPNSPSAQLAKEEQRRKKRRLKKRIFAAVSEGCVEELVELLVELQELCRRRHDEDVPDFLMHKLTASDTGKTCLMKALLNINPNTKEIVRILLAFAEENDILGRFINAEYTEEAYEGQTALNIAIERRQGDIAALLIAAGADVNAHAKGAFFNPKYQHEGFYFGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFFIQAVLVILSVFLYLFAYKEYLACLVLAMALGWANMLYYTRGFQSMGMYSVMIQKVILHDVLKFLFVYIVFLLGFGVALASLIEKCPKDNKDCSSYGSFSDAVLELFKLTIGLGDLNIQQNSKYPILFLFLLITYVILTFVLLLNMLIALMGETVENVSKESERIWRLQRARTILEFEKMLPEWLRSRFRMGELCKVAEDDFRLCLRINEVKWTEWKTHVSFLNEDPGPVRRTADFNKIQDSSRNNSKTTLNAFEEVEEFPETSV

SEQ ID NO: 67663 - protein, 871 aa, Homo sapiens
MADSSEGPRAGPGEVAELPGDESGTPGGEAFPLSSLANLFEGEDGSLSPSPADASRPAGPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGQTALHIAIERRCKHYVELLVAQGADVHAQARGRFFQPKDEGGYFYFGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGIFQHIIRREVTDEDTRHLSRKFKDWAYGPVYSSLYDLSSLDTCGEEASVLEILVYNSKIENRHEMLAVEPINELLRDKWRKFGAVSFYINVVSYLCAMVIFTLTAYYQPLEGTPPYPYRTTVDYLRLAGEVITLFTGVLFFFTNIKDLFMKKCPGVNSLFIDGSFQLLYFIYSVLVIVSAALYLAGIEAYLAVMVFALVLGWMNALYFTRGLKLTGTYSIMIQKILFKDLFRFLLVYLLFMIGYASALVSLLNPCANMKVCNEDQTNCTVPTYPSCRDSETFSTFLLDLFKLTIGMGDLEMLSSTKYPVVFIILLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 67664 - protein, 811 aa, Homo sapiens
MADSSEGPRAGPGEVAELPGDESGTPGGEAFPLSSLANLFEGEDGSLSPSPADASRPAGPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGQTALHIAIERRCKHYVELLVAQGADVHAQARGRFFQPKDEGGYFYFGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGNRHEMLAVEPINELLRDKWRKFGAVSFYINVVSYLCAMVIFTLTAYYQPLEGTPPYPYRTTVDYLRLAGEVITLFTGVLFFFTNIKDLFMKKCPGVNSLFIDGSFQLLYFIYSVLVIVSAALYLAGIEAYLAVMVFALVLGWMNALYFTRGLKLTGTYSIMIQKILFKDLFRFLLVYLLFMIGYASALVSLLNPCANMKVCNEDQTNCTVPTYPSCRDSETFSTFLLDLFKLTIGMGDLEMLSSTKYPVVFIILLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 67665 - protein, 824 aa, Homo sapiens
MADSSEGPRAGPGEVAELPGDESGTPGGEAFPLSSLANLFEGEDGSLSPSPADASRPAGPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGIFQHIIRREVTDEDTRHLSRKFKDWAYGPVYSSLYDLSSLDTCGEEASVLEILVYNSKIENRHEMLAVEPINELLRDKWRKFGAVSFYINVVSYLCAMVIFTLTAYYQPLEGTPPYPYRTTVDYLRLAGEVITLFTGVLFFFTNIKDLFMKKCPGVNSLFIDGSFQLLYFIYSVLVIVSAALYLAGIEAYLAVMVFALVLGWMNALYFTRGLKLTGTYSIMIQKILFKDLFRFLLVYLLFMIGYASALVSLLNPCANMKVCNEDQTNCTVPTYPSCRDSETFSTFLLDLFKLTIGMGDLEMLSSTKYPVVFIILLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 67666 - protein, 871 aa, Homo sapiens; identical to SEQ ID NO: 67663

SEQ ID NO: 67667 - protein, 837 aa, Homo sapiens
MADSSEGPRAGPGEVAELPGDESGTPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGQTALHIAIERRCKHYVELLVAQGADVHAQARGRFFQPKDEGGYFYFGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGIFQHIIRREVTDEDTRHLSRKFKDWAYGPVYSSLYDLSSLDTCGEEASVLEILVYNSKIENRHEMLAVEPINELLRDKWRKFGAVSFYINVVSYLCAMVIFTLTAYYQPLEGTPPYPYRTTVDYLRLAGEVITLFTGVLFFFTNIKDLFMKKCPGVNSLFIDGSFQLLYFIYSVLVIVSAALYLAGIEAYLAVMVFALVLGWMNALYFTRGLKLTGTYSIMIQKILFKDLFRFLLVYLLFMIGYASALVSLLNPCANMKVCNEDQTNCTVPTYPSCRDSETFSTFLLDLFKLTIGMGDLEMLSSTKYPVVFIILLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 67668 - protein, 811 aa, Homo sapiens; identical to SEQ ID NO: 67664

SEQ ID NO: 67669 - protein, 824 aa, Homo sapiens; identical to SEQ ID NO: 67665

SEQ ID NO: 67670 - protein, 764 aa, Homo sapiens
MADSSEGPRAGPGEVAELPGDESGTPGGEAFPLSSLANLFEGEDGSLSPSPADASRPAGPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGNRHEMLAVEPINELLRDKWRKFGAVSFYINVVSYLCAMVIFTLTAYYQPLEGTPPYPYRTTVDYLRLAGEVITLFTGVLFFFTNIKDLFMKKCPGVNSLFIDGSFQLLYFIYSVLVIVSAALYLAGIEAYLAVMVFALVLGWMNALYFTRGLKLTGTYSIMIQKILFKDLFRFLLVYLLFMIGYASALVSLLNPCANMKVCNEDQTNCTVPTYPSCRDSETFSTFLLDLFKLTIGMGDLEMLSSTKYPVVFIILLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 67671 - protein, 729 aa, Homo sapiens
MGGFLPKAEGPGSQLQKLLPSFLVREQDWDQHLDKLHMLQQKRILESPLLRASKENDLSVLRQLLLDCTCDVRQRGALGETALHIAALYDNLEAALVLMEAAPELVFEPTTCEAFAGQTALHIAVVNQNVNLVRALLTRRASVSARATGTAFRRSPRNLIYFGEHPLSFAACVNSEEIVRLLIEHGADIRAQDSLGNTVLHILILQPNKTFACQMYNLLLSYDGHGDHLQPLDLVPNHQGLTPFKLAGVEGNTVMFQHLMQKRRHIQWTYGPLTSILYDLTEIDSWGEELSFLELVVSSDKREARQILEQTPVKELVSFKWNKYGRPYFCILAALYLLYMICFTTCCVYRPLKFRGGNRTHSRDITILQQKLLQEAYETREDIIRLVGELVSIVGAVIILLLEIPDIFRVGASRYFGKTILGGPFHVIIITYASLVLVTMVMRLTNTNGEVVPMSFALVLGWCSVMYFTRGFQMLGPFTIMIQKMIFGDLMRFCWLMAVVILGFASAFYIIFQTEDPTSLGQFYDYPMALFTTFELFLTVIDAPANYDVDLPFMFSIVNFAFAIIATLLMLNLFIAMMGDTHWRVAQERDELWRAQVVATTVMLERKLPRCLWPRSGICGCEFGLGDRWFLRVENHNDQNPLRVLRYVEVFKNSDKEDDQEHPSEKQPSGAESGTLARASLALPTSSLSRTASQSSSHRGWEILRQNTLGHLNLGLNLSEGDGEEVYHF

SEQ ID NO: 67672 - protein, 381 aa, Homo sapiens [sequence omitted]

SEQ ID NO: 67673 - protein, 557 aa, Homo sapiens
MGLSLPKEKGLILCLWSKFCRWFQDSLGNTVLHILILQPNKTFACQMYNLLLSYDRHGDHLQPLDLVPNHQGLTPFKLAGVEGNTVMFQHLMQKRKHTQWTYGPLTSTLYDLTEIDSSGDEQSLLELIITTKKREARQILDQTPVKELVSLKWKRYGRPYFCMLGAIYLLYIICFTMCCIYRPLKPRTNNRTSPRDNTLLQQKLLQEAYMTPKDDIRLVGELVTVIGAIIILLVEVPDIFRMGVTRFFGQTILGGPFHVLIITYAFMVLVTMVMRLISASGEVVPMSFALVLGWCNVMYFARGFQMLGPFTIMIQKMIFGDLMRFCWLMAVVILGFASAFYIIFQTEDPEELGHFYDYPMALFSTFELFLTIIDGPANYNVDLPFMYSITYAAFAIIATLLMLNLLIAMMGDTHWRVAHERDELWRAQIVATTVMLERKLPRCLWPRSGICGREYGLGDRWFLRVEDRQDLNRQRIQRYAQAFHTRGSEDLDKDSVEKLELGCPFSPHLSLPMPSVSRSTSRSSANWERLRQGTLRRDLRGIINRGLEDGESWEYQI

SEQ ID NO: 67674 - protein, 725 aa, Homo sapiens
MGLSLPKEKGLILCLWSKFCRWFQRRESWAQSRDEQNLLQQKRIWESPLLLAAKDNDVQALNKLLKYEDCKVHQRGAMGETALHIAALYDNLEAAMVLMEAAPELVFEPMTSELYEGQTALHIAVVNQNMNLVRALLARRASVSARATGTAFRRSPCNLIYFGEHPLSFAACVNSEEIVRLLIEHGADIRAQDSLGNTVLHILILQPNKTFACQMYNLLLSYDRHGDHLQPLDLVPNHQGLTPFKLAGVEGNTVMFQHLMQKRKHTQWTYGPLTSTLYDLTEIDSSGDEQSLLELIITTKKREARQILDQTPVKELVSLKWKRYGRPYFCMLGAIYLLYIICFTMCCIYRPLKPRTNNRTSPRDNTLLQQKLLQEAYMTPKDDIRLVGELVTVIGAIIILLVEVPDIFRMGVTRFFGQTILGGPFHVLIITYAFMVLVTMVMRLISASGEVVPMSFALVLGWCNVMYFARGFQMLGPFTIMIQKMIFGDLMRFCWLMAVVILGFASAFYIIFQTEDPEELGHFYDYPMALFSTFELFLTIIDGPANYNVDLPFMYSITYAAFAIIATLLMLNLLIAMMGDTHWRVAHERDELWRAQIVATTVMLERKLPRCLWPRSGICGREYGLGDRWFLRVEDRQDLNRQRIQRYAQAFHTRGSEDLDKDSVEKLELGCPFSPHLSLPMPSVSRSTSRSSANWERLRQGTLRRDLRGIINRGLEDGESWEYQI

SEQ ID NO: 67675 - protein, 55 aa, Homo sapiens
MSTSRKLKSHGMRRSKSRSPHKGVKRGGSKRKYRKGNLKSRKRGDDANRNYRSHL

SEQ ID NO: 67676 - protein, 138 aa, Homo sapiens
MDTQTHSLPITHTQLHSNSQPQSRTCTRHCQTFSQSCRQSHRGSRSQSSSQSPASHRNPTGAHSSSGHQSQSPNTSPPPKRHKKTMNSHHSPMRPTILHCRCPKNRKNLEGKLKKKKMAKRIQQVYKTKTRSSGWKSN

SEQ ID NO: 67677 - protein, 576 aa, Homo sapiens
MAVLFFHTMRYKSQDPRNPHNDRFVLSKGHAAPILYAVWAEAGFLAEAELLNLRKISSDLDGHPVPKQAFTDVATGSLGQGLGAACGMAYTGKYFDKASYRVYCLLGDGELSEGSVWEAMAFASIYKLDNLVAILDINRLGQSDPAPLQHQMDIYQKRCEAFGWHAIIVDGHSVEELCKAFGQAKHQPTAIIAKTFKGRGITGVEDKESWHGKPLPKNMAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 67678 - protein, 457 aa, Homo sapiens
MAFASIYKLDNLVAILDINRLGQSDPAPLQHQMDIYQKRCEAFGWHAIIVDGHSVEELCKAFGQAKHQPTAIIAKTFKGRGITGVEDKESWHGKPLPKNMAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 67679 - protein, 623 aa, Homo sapiens
MESYHKPDQQKLQALKDTANRLRISSIQATTAAGSGHPTSCCSAAEIMAVLFFHTMRYKSQDPRNPHNDRFVLSKGHAAPILYAVWAEAGFLAEAELLNLRKISSDLDGHPVPKQAFTDVATGSLGQGLGAACGMAYTGKYFDKASYRVYCLLGDGELSEGSVWEAMAFASIYKLDNLVAILDINRLGQSDPAPLQHQMDIYQKRCEAFGWHAIIVDGHSVEELCKAFGQAKHQPTAIIAKTFKGRGITGVEDKESWHGKPLPKNMAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 67680 - protein, 623 aa, Homo sapiens; identical to SEQ ID NO: 67679

SEQ ID NO: 67681 - protein, 631 aa, Homo sapiens
MESYHKPDQQKLQALKDTANRLRISSIQATTAAGSGHPTSCCSAAEIMAVLFFHTMRYKSQDPRNPHNDRFVLSKGHAAPILYAVWAEAGFLAEAELLNLRKISSDLDGHPVPKQAFTDVATGSLGQGLGAACGMAYTGKYFDKASLPSSWDYSYRVYCLLGDGELSEGSVWEAMAFASIYKLDNLVAILDINRLGQSDPAPLQHQMDIYQKRCEAFGWHAIIVDGHSVEELCKAFGQAKHQPTAIIAKTFKGRGITGVEDKESWHGKPLPKNMAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 67682 - protein, 336 aa, Homo sapiens
MSVLFFYIMRYKQSDPENPDNDRFVLAKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 67683 - protein, 596 aa, Homo sapiens
MADAEARAEFPEEARPDRGTLQVLQDMASRLRIHSIRATCSTSSGHPTSCSSSSEIMSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 67684 - protein, 557 aa, Homo sapiens
MSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKGVSMLQDSWSSVISYQKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 67685 - protein, 540 aa, Homo sapiens
MSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 67686 - protein, 297 aa, Homo sapiens
MSAWAAASLSRAAARCLLARGPGVRAAPPRDPRPSHPEPRGCGAAPGRTLHFTAAVPAGHNKWSKVRHIKGPKDVERSRIFSKLCLNIRLAVKEGGPNPEHNSNLANILEVCRSKHMPKSTIETALKMEKSKDTYLLYEGRGPGGSSLLIEALSNSSHKCQADIRHILNKNGGVMAVGARHSFDKKGVIVVEVEDREKKAVNLERALEMAIEAGAEDVKETEDEEERNVFKFICDASSLHQVRKKLDSLGLCSVSCALEFIPNSKVQLAEPDLEQAAHLIQALSNHEDVIHVYDNIE

SEQ ID NO: 67687 - protein, 228 aa, Homo sapiens
MSVSEIFVELQGFLAAEQDIREEIRKVVQSLEQTAREILTLLQGVHQGAGFQDIPKRCLKAREHFGTVKTHLTSLKTKFPAEQYYRFHEHWRFVLQRLVFLAAFVVYLETETLVTREAVTEILGIEPDREKGFHLDVEDYLSGVLILASELSRLSVNSVTAGDYSRPLHISTFINELDSGFRLLNLKNDSLRKRYDGLKYDVKKVEEVVYDLSIRGFNKETAAACVEK

SEQ ID NO: 67688 - protein, 194 aa, Homo sapiens
MSVSEIFVELQGFLAAEQDIPKRCLKAREHFGTVKTHLTSLKTKFPAEQYYRFHEHWRFVLQRLVFLAAFVVYLETETLVTREAVTEILGIEPDREKGFHLDVEDYLSGVLILASELSRLSVNSVTAGDYSRPLHISTFINELDSGFRLLNLKNDSLRKRYDGLKYDVKKVEEVVYDLSIRGFNKETAAACVEK

SEQ ID NO: 67689 - protein, 148 aa, Homo sapiens
MSVSEIFVELQGFLAAEQDIREEIRKVVQSLEQTAREILTLLQGVHQGAGFQDIPKRCLKAREHFGTVKTHLTSLKTKFPAEQYYRFHEHWRFVLQRLVFLAAFVVYLETETLVTREAVTEILGIEAVCQQRDCWRLLPTPPHLHLHQ

SEQ ID NO: 67690 - protein, 290 aa, Homo sapiens
MSNKEGSGGFRKRKHDNFPHNQRREGKDVNSSSPVMLAFKSFQQELDARHDKYERLVKLSRDITVESKRTIFLLHRITSAPDMEDILTESEIKLDGVRQKIFQVAQELSGEDMHQFHRAITTGLQEYVEAVSFQHFIKTRSLISMDEINKQLIFTTEDNGKENKTPSSDAQDKQFGTWRLRVTPVDYLLGVADLTGELMRMCINSVGNGDIDTPFEVSQFLRQVYDGFSFIGNTGPYEVSKKLYTLKQSLAKVENACYALKVRGSEIPKHMLADVFSVKTEMIDQEEGIS

SEQ ID NO: 67691 - protein, 163 aa, Homo sapiens
MSNKEGSGGFRKRKHDNFPHNQRREGKDVNSSSPVMLAFKSFQQELDARHDKYERLVKLSRDITVESKRTIFLLHRITSSQYLDHSAPDMEDILTESEIKLDGVRQKIFQVAQELSGEDMHQFHRAITTGLQEYVEAVSFQHFIKTRSLISMDEINKQLIFTT

SEQ ID NO: 67692 - protein, 90 aa, Homo sapiens
MDPLRAQQLAAELEVEMMADMYNRMTSACHRKCVPPHYKEAELSKGESVCLDRCVSKYLDIHERMGKKLTELSMQDEELMKRVQQSSGPA

SEQ ID NO: 67693 - protein, 90 aa, Homo sapiens; identical to SEQ ID NO: 67692

SEQ ID NO: 67694 - protein, 90 aa, Homo sapiens; identical to SEQ ID NO: 67692

SEQ ID NO: 67695 - protein, 95 aa, Homo sapiens
MEGGFGSDFGGSGSGKLDPGLIMEQVKVQIAVANAQELLQRMTDKCFRKCIGKPGGSLDNSEQKCIAMCMDRYMDAWNTVSRAYNSRLQRERANM

SEQ ID NO: 67696 - protein, 171 aa, Homo sapiens
MEEYAREPCPWRIVDDCGGAFTMGTIGGGIFQAIKGFRNSPVGVNHRLRGSLTAIKTRAPQLGGSFAVWGGLFSMIDCSMVQVRGKEDPWNSITSGALTGAILAARNGPVAMVGSAAMGGILLALIEGAGILLTRFASAQFPNGPQFAEDPSQLPSTQLPSSPFGDYRQYQ

SEQ ID NO: 67697 - protein, 172 aa, Homo sapiens
MEEYAREPCPWRIVDDCGGAFTMGVIGGGVFQAIKGFRNAPVGIRHRLRGSANAVRIRAPQIGGSFAVWGGLFSTIDCGLVRLRGKEDPWNSITSGALTGAVLAARSGPLAMVGSAMMGGILLALIEGVGILLTRYTAQQFRNAPPFLEDPSQLPPKDGTPAPGYPSYQQYH

SEQ ID NO: 67698 - protein, 222 aa, Homo sapiens
MEEYAREPCPWRIVDDCGGAFTMGVIGGGVFQAIKGFRNAPVCRLLSEAPLFIYSCSRSVSPTVNVSSERAESRPTLFMAVSLHMAWCLAHIGIRHRLRGSANAVRIRAPQIGGSFAVWGGLFSTIDCGLVRLRGKEDPWNSITSGALTGAVLAARSGPLAMVGSAMMGGILLALIEGVGILLTRYTAQQFRNAPPFLEDPSQLPPKDGTPAPGYPSYQQYH

SEQ ID NO: 67699 - protein, 194 aa, Homo sapiens
MAAAAPNAGGSAPETAGSAEAPLQYSLLLQYLVGDKRQPRLLEPGSLGGIPSPAKSEEQKMIEKAMESCAFKAALACVGGFVLGGAFGVFTAGIDTNVGFDPKDPYRTPTAKEVLKDMGQRGMSYAKNFAIVGAMFSCTECLIESYRGTSDWKNSVISGCITGGAIGFRAGLKAGAIGCGGFAAFSAAIDYYLR

SEQ ID NO: 67700 - protein, 209 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTGAAFGAMNGLRLGLKETQNMAWSKPRNVQILNMVTRQGALWANTLGSLALLYSAFGVIIEKTRGAEDDLNTVAAGTMTGMLYKCTGGLRGIARGGLTGLTLTSLYALYNNWEHMKGSLLQQSL

SEQ ID NO: 67701 - protein, 161 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTALLYSAFGVIIEKTRGAEDDLNTVAAGTMTGMLYKCTGGLRGIARGGLTGLTLTSLYALYNNWEHMKGSLLQQSL

SEQ ID NO: 67702 - protein, 172 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTGALWANTLGSLALLYSAFGVIIEKTRGAEDDLNTVAAGTMTGMLYKCTGGLRGIARGGLTGLTLTSLYALYNNWEHMKGSLLQQSL

SEQ ID NO: 67703 - protein, 126 aa, Homo sapiens
MTGAAFGAMNGLRLGLKETQNMAWSKPRNVQILNMVTRQGALWANTLGSLALLYSAFGVIIEKTRGAEDDLNTVAAGTMTGMLYKCTASASQSARIADGLIFTEFCSVARLQGSGTILAHYNLHLP

SEQ ID NO: 67704 - protein, 107 aa, Homo sapiens
  MOD_RES (1)..(1): Any amino acid
XGGSGNKTTGGLAGFFGAGGAGYSHADLAGVPPLLYSAFGVIIEKTRGAEDDLNTVAAGTMTGMLYKCTGGLRGIARGGLTGLTLTSLYALYNNWEHMKGSLLQQSL

SEQ ID NO: 67705 - protein, 452 aa, Homo sapiens
MAAAALRSGWCRCPRRCLGSGIQFLSSHNLPHGSTYQMRRPGGELPLSKSYSSGNRKGFLSGLLDNVKQELAKNKEMKESIKKFRDEARRLEESDVLQEARRKYKTIESETVRTSEVLRKKLGELTGTVKESLHEVSKSDLGRKIKEGVEEAAKTAKQSAESVSKGGEKLGRTAAFRALSQGVESVKKEIDDSVLGQTGPYRRPQRLRKRTEFAGDKFKEEKVFEPNEEALGVVLHKDSKWYQQWKDFKENNVVFNRFFEMKMKYDESDNAFIRASRALTDKVTDLLGGLFSKTEMSEVLTEILRVDPAFDKDRFLKQCENDIIPNVLEAMISGELDILKDWCYEATYSQLAHPIQQAKALGLQFHSRILDIDNVDLAMGKMMEQGPVLIITFQAQLVMVVRNPKGEVVEGDPDKVLRMLYVWALCRDQDELNPYAAWRLLDISASSTEQIL

SEQ ID NO: 67706 - protein, 97 aa, Homo sapiens
MDSSSSSSAAGLGAVDPQLQHFIEVETQKQRFQQLVHQMTELCWEKCMDKPGPKLDSRAEACFVNCVERFIDTSQFILNRLEQTQKSKPVFSESLSD

SEQ ID NO: 67707 - protein, 89 aa, Homo sapiens
MAAQIPESDQIKQFKEFLGTYNKLTETCFLDCVKDFTTREVKPEETTCSEHCLQKYLKMTQRISMRFQEYHIQQNEALAAKAGLLGQPR

SEQ ID NO: 67708 - protein, 89 aa, Homo sapiens; identical to SEQ ID NO: 67707

SEQ ID NO: 67709 - protein, 44 aa, Homo sapiens
MAAQIPESDQIKQFKEFLGTYNKLTETCFLDCVKDFTTREVKPE

SEQ ID NO: 67710 - protein, 89 aa, Homo sapiens; identical to SEQ ID NO: 67707

SEQ ID NO: 67711 - protein, 89 aa, Homo sapiens; identical to SEQ ID NO: 67707

SEQ ID NO: 67712 - protein, 142 aa, Homo sapiens
MAAAVAAAGAGEPQSPDELLPKGDAEKPEEELEEDDDEELDETLSERLWGLTEMFPERVRSAAGATFDLSLFVAQKMYRFSRAALWIGTTSFMILVLPVVFETEKLQMEQQQQLQQRQILLGPNTGLSGGMPGALPSLPGKI

SEQ ID NO: 67713 - protein, 361 aa, Homo sapiens
MGNVLAASSPPAGPPPPPAPALVGLPPPPPSPPGFTLPPLGGSLGAGTSTSRSSERTPGAATASASGAAEDGACGCLPNPGTFEECHRKCKELFPIQMEGVKLTVNKGLSNHFQVNHTVALSTIGESNYHFGVTYVGTKQLSPTEAFPVLVGDMDNSGSLNAQVIHQLGPGLRSKMAIQTQQSKFVNWQVDGEYRGSDFTAAVTLGNPDVLVGSGILVAHYLQSITPCLALGGELVYHRRPGEEGTVMSLAGKYTLNNWLATVTLGQAGMHATYYHKASDQLQVGVEFEASTRMQDTSVSFGYQLDLPKANLLFKGSVDSNWIVGATLEKKLPPLPLTLALGAFLNHRKNKFQCGFGLTIG

SEQ ID NO: 67714 - protein, 361 aa, Homo sapiens; identical to SEQ ID NO: 67713

SEQ ID NO: 67715 - protein, 361 aa, Homo sapiens; identical to SEQ ID NO: 67713

SEQ ID NO: 67716 - protein, 150 aa, Homo sapiens
MPSSGSVSRSRQRGRSMASRGFDGSRRGSLRRAGAREPPSEVIEAAAQASGSCWSSPFFSASTPSAAATGVPGPTDMAAVLQQVLERTELNKLPKSVQNKLEKFLADQQSEIDGLKGRHEKFKVESEQQYFEIEKRLSHSQERLVNETRE

SEQ ID NO: 67717 - protein, 2363 aa, Homo sapiens
MAAVLQQVLERTELNKLPKSVQNKLEKFLADQQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTEDVKRLNEKLKESNTTKGELQLKLDELQASDVSVKYREKRLEQEKELLHSQNTWLNTELKTKTDELLALGREKGNEILELKCNLENKKEEVSRLEEQMNGLKTSNEHLQKHVEDLLTKLKEAKEQQASMEEKFHNELNAHIKLSNLYKSAADDSEAKSNELTRAVEELHKLLKEAGEANKAIQDHLLEVEQSKDQMEKEMLEKIGRLEKELENANDLLSATKRKGAILSEEELAAMSPTAAAVAKIVKPGMKLTELYNAYVETQDQLLLEKLENKRINKYLDEIVKEVEAKAPILKRQREEYERAQKAVASLSVKLEQAMKEIQRLQEDTDKANKQSSVLERDNRRMEIQVKDLSQQIRVLLMELEEARGNHVIRDEEVSSADISSSSEVISQHLVSYRNIEELQQQNQRLLVALRELGETREREEQETTSSKITELQLKLESALTELEQLRKSRQHQMQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGILERSETETKQRLSSQIEKLEHEISHLKKKLENEVEQRHTLTRNLDVQLLDTKRQLDTETNLHLNTKELLKNAQKEIATLKQHLSNMEVQVASQSSQRTGKGQPSNKEDVDDLVSQLRQTEEQVNDLKERLKTSTSNVEQYQAMVTSLEESLNKEKQVTEEVRKNIEVRLKESAEFQTQLEKKLMEVEKEKQELQDDKRRAIESMEQQLSELKKTLSSVQNEVQEALQRASTALSNEQQARRDCQEQAKIAVEAQNKYERELMLHAADVEALQAAKEQVSKMASVRQHLEETTQKAESQLLECKASWEERERMLKDEVSKCVCRCEDLEKQNRLLHDQIEKLSDKVVASVKEGVQGPLNVSLSEEGKSQEQILEILRFIRREKEIAETRFEVAQVESLRYRQRVELLERELQELQDSLNAEREKVQVTAKTMAQHEELMKKTETMNVVMETNKMLREEKERLEQDLQQMQAKVRKLELDILPLQEANAELSEKSGMLQAEKKLLEEDVKRWKARNQHLVSQQKDPDTEEYRKLLSEKEVHTKRIQQLTEEIGRLKAEIARSNASLTNNQNLIQSLKEDLNKVRTEKETIQKDLDAKIIDIQEKVKTITQVKKIGRRYKTQYEELKAQQDKVMETSAQSSGDHQEQHVSVQEMQELKETLNQAETKSKSLESQVENLQKTLSEKETEARNLQEQTVQLQSELSRLRQDLQDRTTQEEQLRQQITEKEEKTRKAIVAAKSKIAHLAGVKDQLTKENEELKQRNGALDQQKDELDVRITALKSQYEGRISRLERELREHQERHLEQRDEPQEPSNKVPEQQRQITLKTTPASGERGIASTSDPPTANIKPTPVVSTPSKVTAAAMAGNKSTPRASIRPMVTPATVTNPTTTPTATVMPTTQVESQEAMQSEGPVEHVPVFGSTSGSVRSTSPNVQPSISQPILTVQQQTQATAFVQPTQQSHPQIEPANQELSSNIVEVVQSSPVERPSTSTAVFGTVSATPSSSLPKRTREEEEDSTIEASDQVSDDTVEMPLPKKLKSVTPVGTEEEVMAEESTDGEVETQVYNQDSQDSIGEGVTQGDYTPMEDSEETSQSLQIDLGPLQSDQQTTTSSQDGQGKGDDVIVIDSDDEEEDDDENDGEHEDYEEDEEDDDDDEDDTGMGDEGEDSNEGTGSADGNDGYEADDAEGGDGTDPGTETEESMGGGEGNHRAADSQNSGEGNTGAAESSFSQEVSREQQPSSASERQAPRAPQSPRRPPHPLPPRLTIHAPPQELGPPVQRIQMTRRQSVGRGLQLTPGIGGMQQHFFDDEDRTVPSTPTLVVPHRTDGFAEAIHSPQVAGVPRFRFGPPEDMPQTSSSHSDLGQLASQGGLGMYETPLFLAHEEESGGRSVPTTPLQVAAPVTVFTESTTSDASEHASQSVPMVTTSTGTLSTTNETATGDDGDEVFVEAESEGISSEAGLEIDSQQEEEPVQASDESDLPSTSQDPPSSSSVDTSSSQPKPFRRVRLQTTLRQGVRGRQFNRQRGVSHAMGGRGGINRGNIN

SEQ ID NO: 67718 - protein, 150 aa, Homo sapiens; identical to SEQ ID NO: 67716

SEQ ID NO: 67719 - protein, 169 aa, Homo sapiens
MAPPWVPAMGFTLAPSLGCFVGSRFVHGEGLRWYAGLQKPSWHPPHWVLGPVWGTLYSAMGYGSYLVWKELGGFTEKAVVPLGLYTGQLALNWAWPPIFFGARQMGWALVDLLLVSGAAAATTVAWYQVSPLAARLLYPYLAWLAFTTTLNYCVWRDNHGWRGGRRLPE

SEQ ID NO: 67720 - protein, 169 aa, Homo sapiens; identical to SEQ ID NO: 67719

SEQ ID NO: 67721 - protein, 102 aa, Homo sapiens
MAPHLLWCPTNGLGLGGSPAGQWGGGSHYRGLVPGEPAGRPPALPLPGLAGLHDHTQLLRMAGQPWLAWGTAAARVSARPTRDCSCTSRCHHACDVVAVTLS

SEQ ID NO: 67722 - protein, 107 aa, Homo sapiens
MAPPWVPAMGFTLAPSLGCFVGSRFVHGEGLRWYAGLQKPSWHPPHWVLGPVWGTLYSAMGYGSYLVWKELGGFTEKAVVPLGLYTGQLALNWAWPPIFFGARQMGW

SEQ ID NO: 67723 - protein, 202 aa, Homo sapiens
MCYGKCARCIGHSLVGLALLCIAANILLYFPNGETKYASENHLSRFVWFFSGIVGGGLLMLLPAFVFIGLEQDDCCGCCGHENCGKRCAMLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQQYDC

SEQ ID NO: 67724 - protein, 232 aa, Homo sapiens
MCYGKCARCIGHSLVGLALLCIAANILLYFPNGETKYASENHLSRFVWFFSGIVGGGLLMLLPAFVFIGLEQDDCCGCCGHENCGKRCAMLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQQMTAKRTNPGQSHNLPLFHCNLYISLVFICKTLY

SEQ ID NO: 67725 - protein, 202 aa, Homo sapiens
MCTGGCARCLGGTLIPLAFFGFLANILLFFPGGKVIDDNDHLSQEIWFFGGILGSGVLMIFPALVFLGLKNNDCCGCCGNEGCGKRFAMFTSTIFAVVGFLGAGYSFIISAISINKGPKCLMANSTWGYPFHDGDYLNDEALWNKCREPLNVVPWNLTLFSILLVVGGIQMVLCAIQVVNGLLGTLCGDCQCCGCCGGDGPV

SEQ ID NO: 67726 - protein, 197 aa, Homo sapiens
MCTGKCARCVGLSLITLCLVCIVANALLLVPNGETSWTNTNHLSLQVWLMGGFIGGGLMVLCPGIAAVRAGGKGCCGAGCCGNRCRMLRSVFSSAFGVLGAIYCLSVSGAGLRNGPRCLMNGEWGYHFEDTAGAYLLNRTLWDRCEAPPRVVPWNVTLFSLLVAASCLEIVLCGIQLVNATIGVFCGDCRKKQDTPH

SEQ ID NO: 67727 - protein, 145 aa, Homo sapiens
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWECWHICSILFLTL

SEQ ID NO: 67728 - protein, 370 aa, Homo sapiens
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWEETYRTIGLYWVGSIIMSVVVFVPGNIVGKYGTRICPAFFLSIPYTCLPVWAGFRIYNQPSENYNYPSKVIQEAQAKDLLRRPFDLMLVVCLLLATGFCLFRGLIALDCPSELCRLYTQFQEPYLKDPAAYPKIQMLAYMFYSVPYFVTALYGLVVPGCSWMPDITLIHAGGLAQAQFSHIGASLHARTAYVYRVPEEAKILFLALNIAYGVLPQLLAYRCIYKPEFFIKTKAEEKVE

SEQ ID NO: 67729 - protein, 339 aa, Homo sapiens
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWEETYRTIGLYWVGSIIMSVVVFVPGNIVGKYGTRICPAFFLSIPYTCLPVWAGFRIYNQPSENYNYPSKVIQEAQAKDLLRRPFDLMLVVCLLLATGFCLFRGLMLAYMFYSVPYFVTALYGLVVPGCSWMPDITLIHAGGLAQAQFSHIGASLHARTAYVYRVPEEAKILFLALNIAYGVLPQLLAYRCIYKPEFFIKTKAEEKVE

SEQ ID NO: 67730 - protein, 373 aa, Homo sapiens
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWDCYRETYRTIGLYWVGSIIMSVVVFVPGNIIGKYGTRICPAFFLSIPYTCLPVWAGFRIYNQPSENYNYPSKVIQEAQAKDLLRRPFDLMLVVCLLLATGFCLFRGLIALDCPSELCRLYTQFQEPYLKDPAAYPKIQMLAYMFYSVPYFVTALYGLVVPGCSWMPDITLIHAGGLAQAQFSHIGASLHARTAYVYRVPEEAKILFLALNIAYGVLPQLLAYRCIYKPEFFIKTKAEEKVE

SEQ ID NO: 67731 - protein, 188 aa, Homo sapiens
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWEETYRTIGLYWVGSIIMSVVVFVPGNIVDAGIYVLFCSLLCDCTVWLSGSWMFLDA

SEQ ID NO: 67732 - protein, 339 aa, Homo sapiens; identical to SEQ ID NO: 67729

SEQ ID NO: 67733 - protein, 351 aa, Homo sapiens
MDIPPLAGKIAALSLSALPVSYALNHVSALSHPLWVALMSALILGLLFVAVYSLSHGEVSYDPLYAVFAVFAFTSVVDLIIALQEDSYVVGFMEFYTKEGEPYLRTAHGVFICYWDGTVHYLLYLAMAGAICRRKRYRNFGLYWLGSFAMSILVFLTGNILGKYSSEIRPAFFLTIPYLLVPCWAGMKVFSQPRALTRCTANMVQEEQRKGLLQRPADLALVIYLILAGFFTLFRGLVVLDCPTDACFVYIYQYEPYLRDPVAYPKVQMLMYMFYVLPFCGLAAYALTFPGCSWLPDWALVFAGGIGQAQFSHMGASMHLRTPFTYRCLQWPAFFHQPPPSDPLALHKKQH

SEQ ID NO: 67734 - protein, 377 aa, Homo sapiens
MDIPPLAGKIAALSLSALPVSYALNHVSALSHPLWVALMSALILGLLFVAVYSLSHGEVSYDPLYAVFAVFAFTSVVDLIIALQEDSYVVGFMEFYTKEGEPYLRTAHGVFICYWDGTVHYLLYLAMAGAICRRKRYRNFGLYWLGSFAMSILVFLTGNILGKYSSEIRPAFFLTIPYLLVPCWAGMKVFSQPRALTRCTANMVQEEQRKGLLQRPADLALVIYLILAGFFTLFRGLVVLDCPTDACFVYIYQYEPYLRDPVAYPKVQMLMYMFYVLPFCGLAAYALTFPGCSWLPDWALVFAGGIGQAQFSHMGASMHLRTPFTYRVPEDTWGCFFVCNLLYALGPHLLAYRCLQWPAFFHQPPPSDPLALHKKQH

SEQ ID NO: 67735 - protein, 213 aa, Homo sapiens
MDIPPLAGKIAALSLSALPVSYALNHVSALSHPLWVALMSALILGLLFVAVYSLSHGEVSYDPLYAVFAVFAFTSVVDLIIALQEDSYVVGFMEFYTKEVLGGRPGSPLPHCPSESPTCPHRESHTCAQRTESSSATGMALFTTSSTWPWPAPSAEGAGGRERVAPDPGREVASSDGVPGQGGARSVCRRNQDASLGLQPGVARRRFQGTSQV

SEQ ID NO: 67736 - protein, 418 aa, Homo sapiens
MAPTQGPRAPLEFGGPLGAAALLLLLPATMFHLLLAARSGPARLLGPPASLPGLEVLWSPRALLLWLAWLGLQAALYLLPARKVAEGQELKDKSRLRYPINGFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGLETISTATGRKLLVSGWWGMVRHPNYLGDLIMALAWSLPCGVSHLLPYFYLLYFTALLVHREARDERQCLQKYGLAWQEYCRRVPYRIMPYIY

SEQ ID NO: 67737 - protein, 391 aa, Homo sapiens
MAPTQGPRAPLEFGGPLGAAALLLLLPATMFHLLLAARSGPARLLGPPASLPGLEVLWSPRALLLWLAWLGLQAALYLLPARKVAEGQELKDKSRLRYPINGFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINGLETISTATGRKLLVSGWWGMVRHPNYLGDLIMALAWSLPCGVSHLLPYFYLLYFTALLVHREARDERQCLQKYGLAWQEYCRRVPYRIMPYIY

SEQ ID NO: 67738 - protein, 302 aa, Homo sapiens
MSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGLETISTATGRKLLVSGWWGMVRHPNYLGDLIMALAWSLPCGVSHLLPYFYLLYFTALLVHREARDERQCLQKYGLAWQEYCRRVPYRIMPYIY

SEQ ID NO: 67739 - protein, 570 aa, Homo sapiens
MGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 67740 - protein, 116 aa, Homo sapiens
MGFLQLLVVAVLASEHRVAGAAEVFGNSSEVYLVVGLIEFSVGKFRYFELNRPFPEEAILHDISSNVTFLIFQIHSQYQNTTVSFSPTLLSNSSETGTASGLVFILRPEQSTCTWY

SEQ ID NO: 67741 - protein, 470 aa, Homo sapiens
MGIWTSGTDIFLSLWEIYVSPRSPGWMDFIQHLGVCCLVALISVGLLSVAACWFLPSIIAAAASWIITCVLLCCSKHARCFILLVFLSCGLREGRNALIAAGTGIVILGHVENIFHNFKGLLDGMTCNLRAKSFSIHFPLLKKYIEAIQWIYGLATPLSVFDDLVSWNQTLAVSLFSPSHVLEAQLNDSKGEVLSVLYQMATTTEVLSSLGQKLLAFAGLSLVLLGTGLFMKRFLGPCGWKYENIYITRQFVQFDERERHQQRPCVLPLNKEERRKYVIIPTFWPTPKERKNLGLFFLPILIHLCIWVLFAAVDYLLYRLIFSVSKQFQSLPGFEVHLKLHGEKQGTQDIIHDSSFNISVFEPNCIPKPKFLLSETWVPLSVILLILVMLGLLSSILMQLKILVSASFYPSVERKRIQYLHAKLLKKRSKQPLGEVKRRLSLYLTKIHFWLPVLKMIRKKQMDMASADKS

SEQ ID NO: 67742 - protein, 188 aa, Homo sapiens
MSTMFADTLLIVFISVCTALLAEGITWVLVYRTDKYKRLKAEVEKQSKKLEKKKETITESAGRQQKKKIERQEEKLKNNNRDLSMVRMKSMFAIGFCFTALMGMFNSIFDGRVVAKLPFTPLSYIQGLSHRNLLGDDTTDCSFIFLYILCTMSIRQNIQKILGLAPSRAATKQAGGFLGPPPPSGKFS

SEQ ID NO: 67743 - protein, 169 aa, Homo sapiens
MSTMFADTLLIVFISVCTALLAEGITWVLVYRTDKYKRLKAEVEKQSKKLEKKKETITESAGRQQKVRMKSMFAIGFCFTALMGMFNSIFDGRVVAKLPFTPLSYIQGLSHRNLLGDDTTDCSFIFLYILCTMSIRQNIQKILGLAPSRAATKQAGGFLGPPPPSGKFS

SEQ ID NO: 67744 - protein, 200 aa, Homo sapiens
MMHYVDYSMMYHLIRGQSVIKLYIIYNMLEVADRLFSSFGQDILDALYWTATEPKERKRAHIGFVEIKGSVFKKFEKNNLFQMSNSDIKERFTNYVLLLIVCLRNMEQFSWNPDHLWVLFPDVCMVIASEIAVDIVKHAFITKFNDITADVYSEYRASLAFDLVSSRQKNAYTDYSDSVARRMGFIPLPLAVLVDIPEST

SEQ ID NO: 67745 - protein, 456 aa, Homo sapiens
MVFGIFLCLDAFLYVFTLLPLRVFLALFRLLTLPCYGLRDRRLLQPAQVCDILKGVILVICYFMMHYVDYSMMYHLIRGQSVIKLYIIYNMLEVADRLFSSFGQDILDALYWTATEPKERKRAHIGVIPHFFMAVLYVFLHAILIMVQATTLNVAFNSHNKSLLTIMMSNNFVEIKGSVFKKFEKNNLFQMSNSDIKERFTNYVLLLIVCLRNMEQFSWNPDHLWVLFPDVCMVIASEIAVDIVKHAFITKFNDITADVYSEYRASLAFDLVSSRQKNAYTDYSDSVARRMGFIPLPLAVLLIRVVTSSIKVQGILSYACVILFYFGLISLKVLNSIVLLGKSCQYVKEAKMEEKLSNPPATCTPGKPSSKSQNKCKPSQGLSTEENLSASITKQPIHQKENIIPLLVTSNSDQFLTTPDGDEKDITQDNSELKHRSSKKDLLEIDRFTICGNRID

SEQ ID NO: 67746 - protein, 567 aa, Homo sapiens
MAGVGDAAAPGEGGGGGVDGPQRDGRGEAEQPGGSGGQGPPPAPQLTETLGFYESDRRRERRRGRTELSLLRFLSAELTRGYFLEHNEAKYTERRERVYTCLRIPRELEKLMVFGIFLCLDAFLYVFTLLPLRVFLALFRLLTLPCYGLRDRRLLQPAQVCDILKGVILVICYFMMHYVDYSMMYHLIRGQSVIKLYIIYNMLEVADRLFSSFGQDILDALYWTATEPKERKRAHIGVIPHFFMAVLYVFLHAILIMVQATTLNVAFNSHNKSLLTIMMSNNFVEIKGSVFKKFEKNNLFQMSNSDIKERFTNYVLLLIVCLRNMEQFSWNPDHLWVLFPDVCMVIASEIAVDIVKHAFITKFNDITADVYSEYRASLAFDLVSSRQKNAYTDYSDSVARRMGFIPLPLAVLLIRVVTSSIKVQGILSYACVILFYFGLISLKVLNSIVLLGKSCQYVKEAKMEEKLSNPPATCTPGKPSSKSQNKCKPSQGLSTEENLSASITKQPIHQKENIIPLLVTSNSDQFLTTPDGDEKDITQDNSELKHRSSKKDLLEIDRFTICGNRID

SEQ ID NO: 67747 - protein, 562 aa, Homo sapiens
MAGVGDAAAPGEGGGGGVDGPQRDGRGEAEQPGGSGGQGPPPAPQLTETLGFYESDRRRERRRGRTELSLLRFLSAELTRGYFLEHNEAKYTERRERVYTCLRIPRELEKLMVFGIFLCLDAFLYVFTLLPLRVFLALFRLLTLPCYGLRDRRLLQPAQVCDILKGVILVICYFMMHYVDYSMMYHLIRGQSVIKLYIIYNMLEVADRLFSSFGQDILDALYWTATEPKERKRAHIGVIPHFFMAVLYVFLHAILIMVQATTLNVAFNSHNKSLLTIMMSNNFVEIKGSVFKKFEKNNLFQMSNSDIKERFTNYVLLLIVCLRNMEQFSWNPDHLWVLFPDVCMVIASEIAVDIVKHAFITKFNDITADVYSEYRASLAFDLVSSRQKNAYTDYSDSVARRMGFIPLPLAVLLIRVVTSSIKVQGILSYACVILFYFGLISLKVLNSIVLLGKSCQYVKEAKMEEKLSNPPATCTPGKPSSKSQNKCKPSQGLSTEENLSASITKQPIHQKENIIPLLVTSNSDQFLTTPDGDEKDITQDNSELKHRSSKSVLLCQSGLPEC

SEQ ID NO: 67748 - protein, 760 aa, Homo sapiens
MSPKKVQIKVEEKEDETEESSSEEEEEVEDKLPRRESLRPKRKRTRDVINEDDPEPEPEDEETRKAREKERRRRLKRGAEEEEIDEEELERLKAELDEKRQIIATVKCKPWKMEKKIEVLKEAKKFVSENEGALGKGKGKRWFAFKMMMAKKWAKFLRDFENFKAACVPWENKIKAIESQFGSSVASYFLFLRWMYGVNMVLFILTFSLIMLPEYLWGLPYGSLPRKTVPRAEEASAANFGVLYDFNGLAQYSVLFYGYYDNKRTIGWMNFRLPLSYFLVGIMCIGYSFLVVLKAMTKNIGDDGGGDDNTFNFSWKVFTSWDYLIGNPETADNKFNSITMNFKEAITEEKAAQVEENVHLIRFLRFLANFFVFLTLGGSGYLIFWAVKRSQEFAQQDPDTLGWWEKNEMNMVMSLLGMFCPTLFDLFAELEDYHPLIALKWLLGRIFALLLGNLYVFILALMDEINNKIEEEKLVKANITLWEANMIKAYNASFSENSTGPPFFVHPADVPRGPCWETMVGQEFVRLTVSDVLTTYVTILIGDFLRACFVRFCNYCWCWDLEYGYPSYTEFDISGNVLALIFNQGMIWMGSFFAPSLPGINILRLHTSMYFQCWAVMCCNVPEARVFKASRSNNFYLGMLLLILFLSTMPVLYMIVSLPPSFDCGPFSGKNRMFEVIGETLEHDFPSWMAKILRQLSNPGLVIAVILVMVLAIYYLNATAKGQKAANLDLKKKMKMQALENKMRNKKMAAARAAAAAGRQ

SEQ ID NO: 67749 - protein, 760 aa, Homo sapiens; identical to SEQ ID NO: 67748

SEQ ID NO: 67750 - protein, 740 aa, Homo sapiens
VEWSGECLRSCRREVQIKVEEKEDETEESSSEEEEEVEDKLPRRESLRPKRKRTRDVINEDDPEPEPEDEETRKAREKERRRRLKRGAEAKKFVSENEGALGKGKGKRWFAFKMMMAKKWAKFLRDFENFKAACVPWENKIKAIESQFGSSVASYFLFLRWMYGVNMVLFILTFSLIMLPEYLWGLPYGSLPRKTVPRAEEASAANFGVLYDFNGLAQYSVLFYGYYDNKRTIGWMNFRLPLSYFLVGIMCIGYSFLVVLKAMTKNIGDDGGGDDNTFNFSWKVFTSWDYLIGNPETADNKFNSITMNFKEAITEEKAAQVEENVHLIRFLRFLANFFVFLTLGGSGYLIFWAVKRSQEFAQQDPDTLGWWEKNEMNMVMSLLGMFCPTLFDLFAELEDYHPLIALKWLLGRIFALLLGNLYVFILALMDEINNKIEEEKLVKANITLWEANMIKAYNASFSENSTGPPFFVHPADVPRGPCWETMVGQEFVRLTVSDVLTTYVTILIGDFLRACFVRFCNYCWCWDLEYGYPSYTEFDISGNVLALIFNQGMIWMGSFFAPSLPGINILRLHTSMYFQCWAVMCCNVPEARVFKASRSNNFYLGMLLLILFLSTMPVLYMIVSLPPSFDCGPFSGKNRMFEVIGETLEHDFPSWMAKILRQLSNPGLVIAVILVMVLAIYYLNATAKGQKAANLDLKKKMKMLQLLVASNKYPESPEKVHFALLFKSNAICERPENKHC

SEQ ID NO: 67751 - protein, 760 aa, Homo sapiens; identical to SEQ ID NO: 67748

SEQ ID NO: 67752 - protein, 727 aa, Homo sapiens
VEWSGECLRSCRREVQIKVEEKEDETEESSSEEEEEVEDKLPRRESLRPKRKRTRDVINEDDPEPEPEDEETRKAREKERRRRLKRGAEAKKFVSENEGALGKGKGKRWFAFKMMMAKKWAKFLRDFENFKAACVPWENKIKAIESQFGSSVASYFLFLRWMYGVNMVLFILTFSLIMLPEYLWGLPYGSLPRKTVPRAEEASAANFGVLYDFNGLAQYSVLFYGYYDNKRTIGWMNFRLPLSYFLVGIMCIGYSFLVVLKAMTKNIGDDGGGDDNTFNFSWKVFTSWDYLIGNPETADNKFNSITMNFKEAITEEKAAQVEENVHLIRFLRFLANFFVFLTLGGSGYLIFWAVKRSQEFAQQDPDTLGWWEKNEMNMVMSLLGMFCPTLFDLFAELEDYHPLIALKWLLGRIFALLLGNLYVFILALMDEINNKIEEEKLVKANITLWEANMIKAYNASFSENSTGPPFFVHPADVPRGPCWETMVGQEFVRLTVSDVLTTYVTILIGDFLRACFVRFCNYCWCWDLEYGYPSYTEFDISGNVLALIFNQGMIWMGSFFAPSLPGINILRLHTSMYFQCWAVMCCNVPEARVFKASRSNNFYLGMLLLILFLSTMPVLYMIVSLPPSFDCGPFSGKNRMFEVIGETLEHDFPSWMAKILRQLSNPGLVIAVILVMVLAIYYLNATAKGQKAANLDLKKKMKMQALENKMRNKKMAAARAAAAAGRQ

SEQ ID NO: 67753 - protein, 554 aa, Homo sapiens
VEWSGECLRSCRREVQIKVEEKEDETEESSSEEEEEVEDKLPRRESLRPKRKRTRDVINEDDPEPEPEDEETRKAREKERRRRLKRGAEAKKFVSENEGALGKGKGKRWFAFKMMMAKKWAKFLRDFENFKAACVPWENKIKAIESQFGSSVASYFLFLRWMYGVNMVLFILTFSLIMLPEYLWGLPYGSLPRKTVPRAEEASAANFGVLYDFNGLAQYSVLFYGYYDNKRTIGWMNFRLPLSYFLVGIMCIGYSFLVVLKAMTKNIGDDGGGDDNTFNFSWKVFTSWDYLIGNPETADNKFNSITMNFKEAITEEKAAQVEENVHLIRFLRFLANFFVFLTLGGSGYLIFWAVKRSQEFAQQDPDTLGWWEKNEMNMVMSLLGMFCPTLFDLFAELEDYHPLIALKWLLGRIFALLLGNLYVFILALMDEINNKIEEEKLVKANITLWEANMIKAYNASFSENSTGPPFFVHPADVPRGPCWETMVGQEFVRLTVSDVLTTYVTILIGDFLRACFVRFCNYCWCWDLEYGYPSYTEFDISGNVLALIFNQGMI

SEQ ID NO: 67754 - protein, 754 aa, Homo sapiens
QIKVEEKEDETEESSSEEEEEVEDKLPRRESLRPKRKRTRDVINEDDPEPEPEDEETRKAREKERRRRLKRGAEEEEIDEEELERLKAELDEKRQIIATVKCKPWKMEKKIEVLKEAKKFVSENEGALGKGKGKRWFAFKMMMAKKWAKFLRDFENFKAACVPWENKIKAIESQFGSSVASYFLFLRWMYGVNMVLFILTFSLIMLPEYLWGLPYGSLPRKTVPRAEEASAANFGVLYDFNGLAQYSVLFYGYYDNKRTIGWMNFRLPLSYFLVGIMCIGYSFLVVLKAMTKNIGDDGGGDDNTFNFSWKVFTSWDYLIGNPETADNKFNSITMNFKEAITEEKAAQVEENVHLIRFLRFLANFFVFLTLGGSGYLIFWAVKRSQEFAQQDPDTLGWWEKNEMNMVMSLLGMFCPTLFDLFAELEDYHPLIALKWLLGRIFALLLGNLYVFILALMDEINNKIEEEKLVKANITLWEANMIKAYNASFSENSTGPPFFVHPADVPRGPCWETMVGQEFVRLTVSDVLTTYVTILIGDFLRACFVRFCNYCWCWDLEYGYPSYTEFDISGNVLALIFNQGMIWMGSFFAPSLPGINILRLHTSMYFQCWAVMCCNVPEARVFKASRSNNFYLGMLLLILFLSTMPVLYMIVSLPPSFDCGPFSGKNRMFEVIGETLEHDFPSWMAKILRQLSNPGLVIAVILVMVLAIYYLNATAKGQKAANLDLKKKMKMQALENKMRNKKMAAARADGAAGRA

SEQ ID NO: 67755 - protein, 906 aa, Homo sapiens
MSHQVKGLKEEARGGVKGRVKSGSPHTGDRLGRRSSSKRALKAEGTPGRRGAQRSQKERAGGSPSPGSPRRKQTGRRRHREELGEQERGEAERTCEGRRKRDERASFQERTAAPKREKEIPRREEKSKRQKKPRSSSLASSASGGESLSEEELAQILEQVEEKKKLIATMRSKPWPMAKKLTELREAQEFVEKYEGALGKGKGKQLYAYKMLMAKKWVKFKRDFDNFKTQCIPWEMKIKDIESHFGSSVASYFIFLRWMYGVNLVLFGLIFGLVIIPEVLMGMPYGSIPRKTVPRAEEEKAMDFSVLWDFEGYIKYSALFYGYYNNQRTIGWLRYRLPMAYFMVGVSVFGYSLIIVIRSMASNTQGSTGEGESDNFTFSFKMFTSWDYLIGNSETADNKYASITTSFKESIVDEQESNKEENIHLTRFLRVLANFLIICCLCGSGYLIYFVVKRSQQFSKMQNVSWYERNEVEIVMSLLGMFCPPLFETIAALENYHPRTGLKWQLGRIFALFLGNLYTFLLALMDDVHLKLANEETIKNITHWTLFNYYNSSGWNESVPRPPLHPADVPRGSCWETAVGIEFMRLTVSDMLVTYITILLGDFLRACFVRFMNYCWCWDLEAGFPSYAEFDISGNVLGLIFNQGMIWMGSFYAPGLVGINVLRLLTSMYFQCWAVMSSNVPHERVFKASRSNNFYMGLLLLVLFLSLLPVAYTIMSLPPSFDCGPFSGKNRMYDVLQETIENDFPTFLGKIFAFLANPGLIIPAILLMFLAIYYLNSVSKSLSRANAQLRKKIQVLREVEKSHKSVKGKATARDSEDTPKSSSKNATQLQLTKEETTPPSASQSQAMDKKAQGPGTSNSASRTTLPASGHLPISRPPGIGPDSGHAPSQTHPWRSASGKSAQRPPH

SEQ ID NO: 67756 - protein, 454 aa, Homo sapiens
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLREKSRTPRGKWRGQPGSGGVCSCCGRLRYACVLALHSLGLALLSALQALMPWRYALKRIGGQFGSSVLSYFLFLKTLLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKGEDKIFLINKLHSIYERKEREERSRVGTTEEAAAPPALLTDEQDA

SEQ ID NO: 67757 - protein, 805 aa, Homo sapiens
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLREKSRTPRGKWRGQPGSGGVCSCCGRLRYACVLALHSLGLALLSALQALMPWRYALKRIGGQFGSSVLSYFLFLKTLLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRNLILKLAILGTLCYHWLGRRVGVLQGQCWEDFVGQELYRFLVMDFVLMLLDTLFGELVWRIISEKKLKRRRKPEFDIARNVLELIYGQTLTWLGVLFSPLLPAVQIIKLLLVFYVKKTSLLANCQAPRRPWLASHMSTVFLTLLCFPAFLGAAVFLCYAVWQVKPSSTCGPFRTLDTMYEAGRVWVRHLEAAGPRVSWLPWVHRYLMENTFFVFLVSALLLAVIYLNIQVVRGQRKVICLLKEQISNEGEDKIFLINKLHSIYERKEREERSRVGTTEEAAAPPALLTDEQDA

SEQ ID NO: 67758 - protein, 384 aa, Homo sapiens
MAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRIISEKKLKRRRKPEFDIARNVLELIYGQTLTWLGVLFSPLLPAVQIIKLLLVFYVKKTSLLANCQAPRRPWLASHMSTVFLTLLCFPAFLGAAVFLCYAVWQVKPSSTCGPFRTLDTMYEAGRVWVRHLEAAGPRVSWLPWVHRYLMENTFFVFLVSALLLAVIYLNIQVVRGQRKVICLLKEQISNEGEDKIFLINKLHSIYERKEREERSRVGTTEEAAAPPALLTDEQDA

SEQ ID NO: 67759 - protein, 138 aa, Homo sapiens
QCWEDFVGQELYRFLVMDFVLMLLDTLFGELENRFQSDVFSSRIWAWWRKPEFDIARNVLELIYGQTLTWLGVLFSPLLPAVQIIKLLLVFYVKKTSLLANCQAPRRPWLASHMSTVFLTLLCFPAFLGAAVFLCYAV

SEQ ID NO: 67760 - protein, 805 aa, Homo sapiens; identical to SEQ ID NO: 67757

SEQ ID NO: 67761 - protein, 227 aa, Homo sapiens
MMAAGAALALALWLLMPPVEVGGAGPPPIQDGEFTFLLPAGRKQCFYQSAPANASLETEYQVIGGAGLDVDFTLESPQGVLLVSESRKADGVHTVEPTEAGDYKLCFDNSFSTISEKLVFFELIFDSLQDDEEVEGWAEAVEPEEMLDVKMEDIKESIETMRTRLERSIQMLTLLRAFEARDRNLQEGNLERVNFWSAVNVAVLLLVAVLQVCTLKRFFQDKRPVPT

SEQ ID NO: 67762 - protein, 211 aa, Homo sapiens
MAGVGAGPLRAMGRQALLLLALCATGAQGLYFHIGETEKRCFIEEIPDETMVIGNYRTQGMHVEVKDPDGKVVLSRQYGSEGRFTFTSHTPGDHQICLHSNSTRMALFAGGKLRVHLDIQVGEHANNYPEIAAKDKLTELQLRARQLLDQVEQIQKEQDYQRYREERFRLTSESTNQRVLWWSIAQTVILILTGIWQMRHLKSFFEAKKLV

SEQ ID NO: 67763 - protein, 227 aa, Homo sapiens
MAGVGAGPLRAMGRQALLLLALCATGAQGLYFHIGETEKRCFIEEIPDETMVIGNYRTQMWDKQKEVFLPSTPGLGMHVEVKDPDGKVVLSRQYGSEGRFTFTSHTPGDHQICLHSNSTRMALFAGGKLRVHLDIQVGEHANNYPEIAAKDKLTELQLRARQLLDQVEQIQKEQDYQRYREERFRLTSESTNQRVLWWSIAQTVILILTGIWQMRHLKSFFEAKKLV

SEQ ID NO: 67764 - protein, 219 aa, Homo sapiens
MSGLSGPPARRGPFPLALLLLFLLGPRLVLAISFHLPINSRKCLREEIHKDLLVTGAYEISDQSGGAGGLRSHLKITDSAGHILYSKEDATKGKFAFTTEDYDMFEVCFESKGTGRIPDQLVILDMKHGVEAKNYEEIAKVEKLKPLEVELRRLEDLSESIVNDFAYMKKREEEMRDTNESTNTRVLYFSIFSMFCLIGLATWQVFYLRRFFKAKKLIE

SEQ ID NO: 67765 - protein, 156 aa, Homo sapiens
MAGWPGAGPLCVLGGAALGVCLAGVAGQLVEPSTAPPKPKPPPLTKETVVFWDMRLWHVVGIFSLFVLSIIITLCCVFNCRVPRTRKEIEARYLQRKAAKMYTDKLETVPPLNELTEVPGEDKKKKKKKKKDSVDTVAIKVEEDEKNEAKKKKGEK

SEQ ID NO: 67766 - protein, 533 aa, Homo sapiens
MNESPDPTDLAGVIIELGPNDSPQTSEFKGATEEAPAKESVLARLSKFEVEDAENVASYDSKIKKIVHSIVSSFAFGLFGVFLVLLDVTLILADLIFTDSKLYIPLEYRSISLAIALFFLMDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVKTPSQKRYVAYFAQVKHLYNWNLPPRRILFIKHFIIYSIPRYVRDLKIQIEMEKKVVFSTISLGKCSVLDNITTDKILIDVFDGLPLYDDVKVQFFYSNLPTYYDNCSFYFWLHTSFIENNRLYLPKNELDNLHKQKARRIYPSDFAVEILFGEKMTSSDVVAGSD

SEQ ID NO: 67767 - protein, 513 aa, Homo sapiens
MNESPDPTDLAGVIIELGPNDSPQTSEFKGATEEAPAKESSKIKKIVHSIVSSFAFGLFGVFLVLLDVTLILADLIFTDSKLYIPLEYRSISLAIALFFLMDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVKTPSQKRYVAYFAQVKHLYNWNLPPRRILFIKHFIIYSIPRYVRDLKIQIEMEKKVVFSTISLGKCSVLDNITTDKILIDVFDGLPLYDDVKVQFFYSNLPTYYDNCSFYFWLHTSFIENNRLYLPKNELDNLHKQKARRIYPSDFAVEILFGEKMTSSDVVAGSD

SEQ ID NO: 67768 - protein, 551 aa, Homo sapiens
MNESPDPTDLAGVIIELGPNDSPQTSEFKGATEEAPAKESPHTSEFKGAARVSPISESVLARLSKFEVEDAENVASYDSKIKKIVHSIVSSFAFGLFGVFLVLLDVTLILADLIFTDSKLYIPLEYRSISLAIALFFLMDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVKTPSQKRYVAYFAQVKHLYNWNLPPRRILFIKHFIIYSIPRYVRDLKIQIEMEKKVVFSTISLGKCSVLDNITTDKILIDVFDGLPLYDDVKVQFFYSNLPTYYDNCSFYFWLHTSFIENNRLYLPKNELDNLHKQKARRIYPSDFAVEILFGEKMTSSDVVAGSD

SEQ ID NO: 67769 - protein, 563 aa, Homo sapiens
MERDSHGNASPARTPSAGASPAQASPAGTPPGRASPAQASPAQASPAGTPPGRASPAQASPAGTPPGRASPGRASPAQASPAQASPARASPALASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLRGGRDSCQGDSGGPLVCEQNNRWYLAGVTSWGTGCGQRNKPGVYTKVTEVLPWIYSKMESSAG

SEQ ID NO: 67770 - protein, 397 aa, Homo sapiens
MDPDSDQPLNSLVKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 67771 - protein, 421 aa, Homo sapiens
MMYRTVGFGTRSRNLKPWMIAVLIVLSLTVVAVTIGLLVHFLVFDQKKEYYHGSFKILDPQINNNFGQSNTYQLKDLRETTENLVSQVDEIFIDSAWKKNYIKNQVVRLTPEEDGVKVDVIMVFQFPSTEQRAVREKKIQSILNQKIRNLRALPINASSVQVNAMSSSTGELTVQASCGKRVVPLNVNRIASGVIAPKAAWPWQASLQYDNIHQCGATLISNTWLVTAAHCFQKYKNPHQWTVSFGTKINPPLMKRNVRRFIIHEKYRSAAREYDIAVVQVSSRVTFSDDIRQICLPEASASFQPNLTVHITGFGALYYGGESQNDLREARVKIISDDVCKQPQVYGNDIKPGMFCAGYMEGIYDACRGDSGGPLVTRDLKDTWYLIGIVSWGDNCGQKDKPGVYTQVTYYRNWIASKTGI

SEQ ID NO: 67772 - protein, 418 aa, Homo sapiens
MMYRTVGFGTRSRNLKPWMIAVLIVLSLTVVAVTIGLLVHFLVFDQKKEYYHGSFKILDPQINNNFGQSNTYQLKDLRETTENLVDEIFIDSAWKKNYIKNQVVRLTPEEDGVKVDVIMVFQFPSTEQRAVREKKIQSILNQKIRNLRALPINASSVQVNAMSSSTGELTVQASCGKRVVPLNVNRIASGVIAPKAAWPWQASLQYDNIHQCGATLISNTWLVTAAHCFQKYKNPHQWTVSFGTKINPPLMKRNVRRFIIHEKYRSAAREYDIAVVQVSSRVTFSDDIRQICLPEASASFQPNLTVHITGFGALYYGGESQNDLREARVKIISDDVCKQPQVYGNDIKPGMFCAGYMEGIYDACRGDSGGPLVTRDLKDTWYLIGIVSWGDNCGQKDKPGVYTQVTYYRNWIASKTGI

SEQ ID NO: 67773 - protein, 417 aa, Homo sapiens
MYRTVGFGTRSRNLKPWMIAVLIVLSLTVVAVTIGLLVHFLVFDQKKEYYHGSFKILDPQINNNFGQSNTYQLKDLRETTENLVDEIFIDSAWKKNYIKNQVVRLTPEEDGVKVDVIMVFQFPSTEQRAVREKKIQSILNQKIRNLRALPINASSVQVNAMSSSTGELTVQASCGKRVVPLNVNRIASGVIAPKAAWPWQASLQYDNIHQCGATLISNTWLVTAAHCFQKYKNPHQWTVSFGTKINPPLMKRNVRRFIIHEKYRSAAREYDIAVVQVSSRVTFSDDIRQICLPEASASFQPNLTVHITGFGALYYGGESQNDLREARVKIISDDVCKQPQVYGNDIKPGMFCAGYMEGIYDACRGDSGGPLVTRDLKDTWYLIGIVSWGDNCGQKDKPGVYTQVTYYRNWIASKTGI

SEQ ID NO: 67774 - protein, 562 aa, Homo sapiens
MERDSHGNASPARTPSAGASPAQASPAGTPPGRASPAQASPAQASPAGTPPGRASPAQASPAGTPPGRASPGRASPLQASPARASPALASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLRGGRDSCQGDSGGPLVCEQNNRWYLAGVTSWGTGCGQRNKPGVYTKVTEVLPWIYSKMESEVRFRKS

SEQ ID NO: 67775 - protein, 586 aa, Homo sapiens
MERDSHGNASPARTPSAGASPAQASPAGTPPGRASPAQASPAQASPAGTPPGRASPAQASPAGTPPGRASPGRASPAQASPAQASPARASPALASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLRGGRDSCQGDSGGPLVCEQNNRWYLAGVTSWGTGCGQRNKPGVYTKVTEVLPWIYSKMEVRSLQQDTAPSRLGTSSGGDPGGAPRL

SEQ ID NO: 67776 - protein, 567 aa, Homo sapiens
MERDSHGNASPARTPSAGASPAQASPAGTPPGRASPAQASPAQASPAGTPPGRASPAQASPAGTPPGRASPGRASPAQASPAQASPARASPALASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLRGGRDSCQGDSGGPLVCEQNNRWYLAGVTSWGTGCGQRNKPGVYTKVTEVLPWIYSKMESEVRFRKS

SEQ ID NO: 67777 - protein, 491 aa, Homo sapiens
MERDSHGNASPARTPSAGASPAQASPAGTPPGRASPAQASPAQASPAGTPPGRASPAQASPAGTPPGRASPGRASPAQASPAQASPARASPALASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSGEGICTPRSPAPQPQHPLQPSHLSASVNSYPGPKASAGQKSKTLKDPYMEHFCFIIRETEAQGL

SEQ ID NO: 67778 - protein, 532 aa, Homo sapiens
MERDSHGNASPARTPSAGASPAQASPAGTPPGRASPAQASPAQASPAGTPPGRASPAQASPAGTPPGRASPGRASPAQASPAQASPARASPALASLSRSSSGRSSSARSASVTTSPTRVYLVRATPVGAVPIRSSPARSAPATRATRESPVQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLRGGRDSCQGDSGGPLVCEQNNRWYLAGVTSWGTGCGQRNKPGVYTKVTEVLPWIYSKMESEVRFRKS

SEQ ID NO: 67779 - protein, 454 aa, Homo sapiens
MGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGAGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 67780 - protein, 538 aa, Homo sapiens
MQAVGPKPLPTLLCGGRTGHRTARVLSFLIRSCPCEPGKGCVYGKPVTLWPTISSVVPSTFLGLGNYEVEVEAEPDVRGPEIVTMGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGAGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 67781 - protein, 344 aa, Homo sapiens
MGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNGTSGSLCGSAALPLFQEDLQLLIEAFL

SEQ ID NO: 67782 - protein, 453 aa, Homo sapiens
MGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 67783 - protein, 437 aa, Homo sapiens
MLQDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 67784 - protein, 432 aa, Homo sapiens
MLQDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 67785 - protein, 435 aa, Homo sapiens
MDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 67786 - protein, 457 aa, Homo sapiens
MSLMLDDQPPMEAQYAEEGPGPGIFRAEPGDQQHPISQAVCWRSMRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPRNNCTSGQVVSLRCSECGARPLASRIVGGQSVAPGRWPWQASVALGFRHTCGGSVLAPRWVVTAAHCMHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 67787 - protein, 811 aa, Homo sapiens
MLLLFHSKRMPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGGPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVT

SEQ ID NO: 67788 - protein, 824 aa, Homo sapiens
MPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGALRADAVALFYGWRNQGSETCCCPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVT

SEQ ID NO: 67789 - protein, 802 aa, Homo sapiens
MPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGGPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVT

SEQ ID NO: 67790 - protein, 824 aa, Homo sapiens; identical to SEQ ID NO: 67788

SEQ ID NO: 67791 - protein, 141 aa, Homo sapiens
MPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTC

SEQ ID NO: 67792 - protein, 461 aa, Homo sapiens
MLLLFHSKRMPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRYHFLSSLWLPFLPPPPSLPSSIVTPSLEAQVPNLRGAARGASRGWGWCQACCP

SEQ ID NO: 67793 - protein, 508 aa, Homo sapiens
MASAVWGSAPWWGPPPPAPARPLTDIDFCSGAQLQELTQLIQELGVQESWSDGPKPGADLLRAKDFVFSLLGLVHRRDPRFPPQAELLLLRGGIREGSLDLGHAPLGPYARGPHYDAGFTLLVPMFSLDGTELQLDLESCYAQVCLPEMVCGTPIREMWQDCLGPPVPGARDSIHRTESEESSKDWQSSVDQPHSYVTEHEAPVSLEKSPSDVSASESPQHDVVDLGSTAPLKTMSSDVTKAAVESPVPKPSEAREAWPTLCSAQVAAWFFATLAAVAESLIPVPGAPRLVHAARHAGFTTVLLATPEPPRRLLLFDLIPVVSVAGWPEGARSHSWAGPLASESASFYLVPGGGTERPCASAWQLCFARQELALKARIPAPLLQAHAAAQALLRPLVAGTRAAAPYLLRTLLYWACERLPALYLARPENAGACCLGLLDELGRVLEAGTLPHYFLNGRQLRTGDDSAALLGELARLRGDPARALRAAVEEAKVARKGGGLAGVGGGAH

SEQ ID NO: 67794 - protein, 508 aa, Homo sapiens; identical to SEQ ID NO: 67793

SEQ ID NO: 67795 - protein, 274 aa, Homo sapiens
MGKSLSHLPLHSSKEDAYDGVTSENMRNGLVNSEVHNEDGRNGDVSQFPYVEFTGRDSVTCPTCQGTGRIPRGQENQLVALIPYSDQRLRPRRTKLYVMASVFVCLLLSGLAVFFLFPRSIDVKYIGVKSAYVSYDVQKRTIYLNITNTLNITNNNYYSVEVENITAQVQFSKTVIGKARLNNITIIGPLDMKQIDYTVPTVIAEEMSYMYDFCTLISIKVHNIVLMMQVTVTTTYFGHSEQISQERYQYVDCGRNTTYQLGQSEYLNVLQPQQ

SEQ ID NO: 67796 - protein, 274 aa, Homo sapiens; identical to SEQ ID NO: 67795

SEQ ID NO: 67797 - protein, 25 aa, Homo sapiens
MGKSLSHLPLHSSKEDAYDGVTSEN

SEQ ID NO: 67798 - protein, 110 aa, Homo sapiens
MGKSLSHLPLHSSKEDAYDGVTSENMRNGLVNSEVHNEDGRNGDVSQFPYVEFTGRDSVTCPTCQGTGRIPRGQENQLVALIPYSDQRLRPRRTKLYVMASVFVCLLLSG

SEQ ID NO: 67799 - protein, 122 aa, Homo sapiens
MHGTFVILLPLSLILMVFGGMTGFLSFLLQAYLLLLLTGILFLFGAMVTLAGISVYIAYSAAAFREALCLLEEKALLDQVDISFGWSLALGWISFIAELLTGAAFLAAARELSLRRRQDQAI

SEQ ID NO: 67800 - protein, 189 aa, Homo sapiens
MGLGARGAWAALLLGTLQVLALLGAAHESAAMAETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 67801 - protein, 208 aa, Homo sapiens
MGLGARGAWAALLLGTLQVLALLGAAHESAAMAASANIENSGLPHNSSANSTETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 67802 - protein, 195 aa, Homo sapiens
MENHKSNNKENITIVDISRKINQLPEAERNLLENGSVYVGLNAALCGLIANSLFRRILNVTKARIAAGLPMAGIPFLTTDLTYRCFVSFPLNTGDLDCETCTITRSGLTGLVIGGLYPVFLAIPVNGGLAARYQSALLPHKGNILSYWIRTSKPVFRKMLFPILLQTMFSAYLGSEQYKLLIKALQLSEPGKEIH

SEQ ID NO: 67803 - protein, 125 aa, Homo sapiens
MAGIPFLTTDLTYRCFVSFPLNTGDLDCETCTITRSGLTGLVIGGLYPVFLAIPVNGGLAARYQSALLPHKGNILSYWIRTSKPVFRKMLFPILLQTMFSAYLGSEQYKLLIKALQLSEPGKEIH

SEQ ID NO: 67804 - protein, 162 aa, Homo sapiens
MLQTSNYSLVLSLQFLLLSYDLFVNSFSELLQKTPVIQLVLFIIQDIAVLFNIIIIFLMFFNTFVFQAGLVNLLFHKFKGTIILTAVYFALSISLHVWVMNLRWKNSNSFIWTDGLQMLFVFQRLAAVLYCYFYKRTAVRLGDPHFYQDSLWLRKEFMQVRR

SEQ ID NO: 67805 - protein, 105 aa, Homo sapiens
MLQTSNYSLVLSLQFLLLSYDLFVNSFSELLQKTPVIQLVLFIIQDIAVLFNIIIIFLMFFNTFVFQAGLVNLLFHKFKGTIILTAVYFALSISLHVWVMVRVAV

SEQ ID NO: 67806 - protein, 379 aa, Homo sapiens
MPHSSLHPSIPCPRGHGAQKAALVLLSACLVTLWGLGEPPEHTLRYLVLHLASLQLGLLLNGVCSLAEELRHIHSRYRGSYWRTVRACLGCPLRRGALLLLSIYFYYSLPNAVGPPFTWMLALLGLSQALNILLGLKGLAPAEISAVCEKGNFNVAHGLAWSYYIGYLRLILPELQARIRTYNQHYNNLLRGAVSQRLYILLPLDCGVPDNLSMADPNIRFLDKLPQQTGDHAGIKDRVYSNSIYELLENGQRAGTCVLEYATPLQTLFAMSQYSQAGFSREDRLEQAKLFCRTLEDILADAPESQNNCRLIAYQEPADDSSFSLSQEVLRHLRQEEKEEVTVGSLKTSAVPSTSTMSQEPELLISGMEKPLPLRTDFS

SEQ ID NO: 67807 - protein, 253 aa, Homo sapiens
MPHSSLHPSIPCPRGHGAQKAALVLLSACLVTLWGLGEPPEHTLRYLVLHLASLQLGLLLNGVCSLAEELRHIHSRYRGSYWRTVRACLGCPLRRGALLLLSIYFYYSLPNAVGPPFTWMLALLGLSQALNILLGLKGLAPAEISAVCEKGNFNVAHGLAWSYYIGYLRLILPELQARIRTYNQHYNNLLRGAVSQRLYILLPLDCGVPDNLSMADPNIRFLDKLPQQTGDHAGIKDRVYSNSIYELLENGQR

SEQ ID NO: 67808 - protein, 140 aa, Homo sapiens
MPSAFSVSSFPVSIPAVLTQTDWTEPWLMGLATFHALCVLLTCLSSRSYRLQIGHFLCLVILVYCAEYINEAAAMNWRLFSKYQYFDSRGMFISIVFSAPLLVNAMIIVVMWVWKTLNVMTDLKNAQERRKEKKRRRKED

SEQ ID NO: 67809 - protein, 127 aa, Homo sapiens
MLSGYLQTDWTEPWLMGLATFHALCVLLTCLSSRSYRLQIGHFLCLVILVYCAEYINEAAAMNWRLFSKYQYFDSRGMFISIVFSAPLLVNAMIIVVMWVWKTLNVMTDLKNAQERRKEKKRRRKED

SEQ ID NO: 67810 - protein, 519 aa, Homo sapiens
GPAQRASSPIPSAGRREGAQAATQRVERRDRDPGGCAAWTPSTLPLSPRSAASSSTCAGGCGKRTASSRRTSRPSRMTATTGPKVIQTSAANFSLNNSKKLKPIQILSNPLSTYNQQLWLTCVVELDQSKETSIKTSFPMTVKVDGVAQDGTTMYIHNKVHNRTRTLTCAGKCAEIIVAHLGYLNYTQYTVIVGFEHLKLPIKGMNFTWKTYNPAFSRLEIWFRFFFVVLTFIVTCLFAHSLRKFSMRDWGIEQKWMSVLLPLLLLYNDPFFPLSFLVNSWLPGMLDDLFQSMFLCALLLFWLCVYHGIRVQGERKCLTFYLPKFFIVGLLWLASVTLGIWQTVNELHDPMYQYRVDTGNFQGMKVFFMVVAAVYILYLLFLIVRACSELRHMPYVDLRLKFLTALTFVVLVISIAILYLRFGAQVLQDNFVAELSTHYQKPAEFLSFYGLLNFYLYTLAFVYSPSKNALYESQLKDNPAFSMLNDSDDDVIYGSDYEEMPLQNGQAIRAKYKEESDSD

SEQ ID NO: 67811 - protein, 612 aa, Homo sapiens
MGAAPSPTQASSRGGGPGPPAPTRAVSSSSRARGGALSALGPSPARPLTTSPAPAPPPRSRPARQQPDPQCWEKRGGAGGDTKGGAAGPGPGRLRGMDAEYPAFEPPLCSELKHLCRRLREAYRELKEDLTPFKDDRYYRLAPMRLYTLSKRHFVLVFVVFFICFGLTIFVGIRGPKVIQTSAANFSLNNSKKLKPIQILSNPLSTYNQQLWLTCVVELDQSKETSIKTSFPMTVKVDGVAQDGTTMYIHNKVHNRTRTLTCAGKCAEIIVAHLGYLNYTQYTVIVGFEHLKLPIKGMNFTWKTYNPAFSRLEIWFRFFFVVLTFIVTCLFAHSLRKFSMRDWGIEQKWMSVLLPLLLLYNDPFFPLSFLVNSWLPGMLDDLFQSMFLCALLLFWLCVYHGIRVQGERKCLTFYLPKFFIVGLLWLASVTLGIWQTVNELHDPMYQYRVDTGNFQGMKVFFMVVAAVYILYLLFLIVRACSELRHMPYVDLRLKFLTALTFVVLVISIAILYLRFGAQVLQDNFVAELSTHYQNSAEFLSFYGLLNFYLYTLAFVYSPSKNALYESQLKDNPAFSMLNDSDDDVIYGSDYEEMPLQNGQAIRAKYKEESDSD

SEQ ID NO: 67812 - protein, 438 aa, Homo sapiens
MPCTCTWRNWRQWIRPLVAVIYLVSIVVAVPLCVWELQKLEVGIHTKAWFIAGIFLLLTIPISLWVILQHLVHYTQPELQKPIIRILWMVPIYSLDSWIALKYPGIAIYVDTCRECYEAYVIYNFMGFLTNYLTNRYPNLVLILEAKDQQKHFPPLCCCPPWAMGEVLLFRCKLGVLQYTVVRPFTTIVALICELLGIYDEGNFSFSNAWTYLVIINNMSQLFAMYCLLLFYKVLKEELSPIQPVGKFLCVKLVVFVSFWQAVVIALLVKVGVISEKHTWEWQTVEAVATGLQDFIICIEMFLAAIAHHYTFSYKPYVQEAEEGSCFDSFLAMWDVSDIRDDISEQVRHVGRTVRGHPRKKLFPEDQDQNEHTSLLSSSSQDAISIASSMPPSPMGHYQGFGHTVTPQTTPTTAKISDEILSDTIGEKKEPSDKSVDS

SEQ ID NO: 67813 - protein, 1383 aa, Homo sapiens
MYATDSRGHSPAFLQPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEGVSLSGFRVEVVDGVKLNLLDDVSSWKPGDQIVVASTDYSMYQAEEFTLLPCSECSHFQVKVKETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 67814 - protein, 1320 aa, Homo sapiens
MYATDSRGHSPAFLQPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 67815 - protein, 376 aa, Homo sapiens
MTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 67816 - protein, 18 aa, Homo sapiens
MYATDSRGHSPAFLQPQN

SEQ ID NO: 67817 - protein, 189 aa, Homo sapiens
MEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLGCVLSNGLCLAGLALEIRSL

SEQ ID NO: 67818 - protein, 189 aa, Homo sapiens; identical to SEQ ID NO: 67817

SEQ ID NO: 67819 - protein, 189 aa, Homo sapiens; identical to SEQ ID NO: 67817

SEQ ID NO: 67820 - protein, 148 aa, Homo sapiens
MLPRGLKMAPRGKRLSSTPLEILFFLNGWYNATYFLLELFIFLYKGVLLPYPTANLVLDVVMLLLYLGIEVIRLFFGTKGNLCQRKMPLSISVALTFPSAMMASYYLLLQTYVLRLEAIMNGILLFFCGSELLLEVLTLAAFSSMDRI

SEQ ID NO: 67821 - protein, 145 aa, Homo sapiens
MLPRGLKMAPRGKRLSSTPLEILFFLNGWYNATYFLLELFIFLYKGVLLPYPTANLVLDVVMLLLYLGIEVIRLFFGTKGNLCQRKMPLSISVALTFPSAMMASYYLLLQTYVLRLEAIMNGILLFFCGSELLLEVLTLAAFSRI

SEQ ID NO: 67822 - protein, 313 aa, Homo sapiens
MRTDSGARLEEGHLRPPRALPPVPSIDDIPLSRPKKKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 67823 - protein, 400 aa, Homo sapiens
MGKNPVRPPRALPPVPSQDDIPLSRPKKKKPRTKNTPASASLEGLAQTAGRRPSEGNEPSTKELKEHPEAPVQRRQKKTRLPLELETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 67824 - protein, 408 aa, Homo sapiens
MRTDSGARLEEGHLRPPRALPPVPSQDDIPLSRPKKKKPRTKNTPASASLEGLAQTAGRRPSEGNEPSTKELKEHPEAPVQRRQKKTRLPLELETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 67825 - protein, 430 aa, Homo sapiens
MTHCACARDRREGWGARCLGRRPPRPAKRRMGKNPVRPPRALPPVPSIDDIPLSRPKKKKPRTKNTPASASLEGLAQTAGRRPSEGNEPSTKELKEHPEAPVQRRQKKTRLPLELETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 67826 - protein, 408 aa, Homo sapiens
MRTDSGARLEEGHLRPPRALPPVPSIDDIPLSRPKKKKPRTKNTPASASLEGLAQTAGRRPSEGNEPSTKELKEHPEAPVQRRQKKTRLPLELETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 67827 - protein, 366 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 67828 - protein, 218 aa, Homo sapiens
MALPPGPAALRHTLLLLPALLSSVKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 67829 - protein, 351 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRAVKPADRQMAQNNSRPELLDPEPGGLLTSQGRRNQDKDA

SEQ ID NO: 67830 - protein, 322 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 67831 - protein, 322 aa, Homo sapiens; identical to SEQ ID NO: 67830

SEQ ID NO: 67832 - protein, 306 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRVKPADRQMAQNNSRPELLDPEPGGLLTSQGRRNQDKDA

SEQ ID NO: 67833 - protein, 381 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRVKPADRQMAQNNSRPELLDPEPGGLLTSQACLLHHGTPALTNPWLPHQQEGALPGGWSPQAHNSTVWKL

SEQ ID NO: 67834 - protein, 269 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQWLLATRVEVPLLGIVVAAGLALGTLVGFSTLVACLVCRKEKKTKGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 67835 - protein, 222 aa, Homo sapiens
MLWLLFFLVTAIHAELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIENGIPSDPLDMKGGHINDAFMTEDERLTPL

SEQ ID NO: 67836 - protein, 361 aa, Homo sapiens
MAMNYNAKDEVDGGPPCAPGGTAKTRRPDNTAFKQQRLPAWQPILTAGTVLPIFFIIGLIFIPIGIGIFVTSNNIREIEIDYTGTEPSSPCNKCLSPDVTPCFCTINFTLEKSFEGNVFMYYGLSNFYQNHRRYVKSRDDSQLNGDSSALLNPSKECEPYRRNEDKPIAPCGAIANSMFNDTLELFLIGNDSYPIPIALKKKGIAWWTDKNVKFRNPPGGDNLEERFKGTTKPVNWLKPVYMLDSDPDNNGFINEDFIVWMRTAALPTFRKLYRLIERKSDLHPTLPAGRYSLNVTYNYPVHYFDGRKRMILSTISWMGGKNPFLGIAYIAVGSISFLLGVVLLVINHKYRNSSNTADITI

SEQ ID NO: 67837 - protein, 242 aa, Homo sapiens
MYYGLSNFYQNHRRYVKSRDDSQLNGDSSALLNPSKECEPYRRNEDKPIAPCGAIANSMFNDTLELFLIGNDSYPIPIALKKKGIAWWTDKNVKFRNPPGGDNLEERFKGTTKPVNWLKPVYMLDSDPDNNGFINEDFIVWMRTAALPTFRKLYRLIERKSDLHPTLPAGRYSLNVTYNYPVHYFDGRKRMILSTISWMGGKNPFLGIAYIAVGSISFLLGVVLLVINHKYRNSSNTADITI

SEQ ID NO: 67838 - protein, 325 aa, Homo sapiens
MAMNYNAKDEVDGGPPCAPGGTAKTRRPDNTAFKQQRLPAWQPILTAGTVLPIFFIIGLIFIPIGIGIFVTSNNIREIEGNVFMYYGLSNFYQNHRRYVKSRDDSQLNGDSSALLNPSKECEPYRRNEDKPIAPCGAIANSMFNDTLELFLIGNDSYPIPIALKKKGIAWWTDKNVKFRNPPGGDNLEERFKGTTKPVNWLKPVYMLDSDPDNNGFINEDFIVWMRTAALPTFRKLYRLIERKSDLHPTLPAGRYSLNVTYNYPVHYFDGRKRMILSTISWMGGKNPFLGIAYIAVGSISFLLGVVLLVINHKYRNSSNTADITI

SEQ ID NO: 67839 - protein, 77 aa, Homo sapiens
MYYGLSNFYQNHRRYVKSRDDSQLNGDSSALLNPSKECEPYRRNEDKPIAPCGAIANSMFNDTLELFLIGNDSYPIP

SEQ ID NO: 67840 - protein, 345 aa, Homo sapiens [sequence omitted]

SEQ ID NO: 67841 - protein, 351 aa, Homo sapiens
MTWSATARGAHQPDNTAFTQQRLPAWQPLLSASIALPLFFCAGLAFIGLGLGLYYSSNGIKELEYDYTGDPGTGNCSVCAAAGQGRALPPPCSCAWYFSLPELFQGPVYLYYELTNFYQNNRRYGVSRDDAQLSGLPSALRHPVNECAPYQRSAAGLPIAPCGAIANSLFNDSFSLWHQRQPGGPYVEVPLDRSGIAWWTDYHVKFRNPPLVNGSLALAFQGTAPPPNWRRPVYELSPDPNNTGFINQDFVVWMRTAALPTFRKLYARIRQGNYSAGLPRGAYRVNITYNYPVRAFGGHKLLIFSSISWMGGKNPFLGIAYLVVGSLCILTGFVMLVVYIRYQDQDDDDEE

SEQ ID NO: 67842 - protein, 351 aa, Homo sapiens; identical to SEQ ID NO: 67841

SEQ ID NO: 67843 - protein, 113 aa, Homo sapiens
MEERAQHCLSRLLDNSALKQQELPIHRLYFTARRVLFVFFATGIFCLCMGIILILSARSTQEIEINYTRICANCAKLRENASNFDKECTCSIPFYLSGKMMVGEIQETRLTLH

SEQ ID NO: 67844 - protein, 68 aa, Homo sapiens
  MOD_RES (1)..(1): Any amino acid
XLCMGIILILSARSTQEIEINYTRICANCAKLRENASNFDKECTCSIPFYLSGKMMVGEIQETRLTLH

SEQ ID NO: 67845 - protein, 400 aa, Homo sapiens
MAANYSSTSTRREHVKVKTSSQPGFLERLSETSGGMFVGLMAFLLSFYLIFTNEGRALKTATSLAEGLSLVVSPDSIHSVAPENEGRLVHIIGALRTSKLLSDPNYGVHLPAVKLRRHVEMYQWVETEESREYTEDGQVKKETRYSYNTEWRSEIINSKNFDREIGHKNPSAMAVESFMATAPFVQIGRFFLSSGLIDKVDNFKSLSLSKLEDPHVDIIRRGDFFYHSENPKYPEVGDLRVSFSYAGLSGDDPDLGPAHVVTVIARQRGDQLVPFSTKSGDTLLLLHHGDFSAEEVFHRELRSNSMKTWGLRAAGWMAMFMGLNLMTRILYTLVDWFPVFRDLVNIGLKAFAFCVATSLTLLTVAAGWLFYRPLWALLIAGLALVPILVARTRVPAKKLE

SEQ ID NO: 67846 - protein, 181 aa, Homo sapiens
MASAGSGMEEVRVSVLTPLKLVGLVCIFLALCLDLGAVLSPAWVTADHQYYLSLWESCRKPASLDIWHCESTLSSDWQIATLALLLGGAAIILIAFLVGLISICVGSRRRFYRPVAVMLFAAVVLQVCSLVLYPIKFIETVSLKIYHEFNWGYGLAWGATIFSFGGAILYCLNPKNYEDYY

SEQ ID NO: 67847 - protein, 559 aa, Homo sapiens
MHSFIHAAMGMVMAWCAAVITQGQYSFLVVPCTGTNSFGSPAAQTCLNEYHLFFLLTGAFMGYSYSLLYFVNNMNYLPFPIIQQYKFLRFRRSLLLLVKHSCVESLFLVRNFCILYYFLGYIPKAWISTAMNLHIDEQVHRPLDTVSGLLNLSLLYHVWLCGVFLLTTWYVSWILFKIYATEAHVFPVQPPFAEGSDECLPKVLNSNPPPIIKYLALQDLMLLSQYSPSRRQEVFSLSQPGGHPHNWTAISRECLNLLNGMTQKLILYQEAAATNGRVSSSYPVEPKKLNSPEETAFQTPKSSQMPRPSVPPLVKTSLFSSKLSTPDVVSPFGTPFGSSVMNRMAGIFDVNTCYGSPQSPQLIRRGPRLWTSASDQQMTEFSNPSPSTSISAEGKTMRQPSVIYSWIQNKREQIKNFLSKRVLIMYFFSKHPEASIQAVFSDAQMHIWALEGLSHLVAASFTEDRFGVVQTTLPAILNTLLTLQEAVDKYFKLPHASSKPPRISGSLVDTSYKTLRFAFRASLKTAIYRITTTFGEHLNAVQASAEHQKRLQQFLEFKE

SEQ ID NO: 67848 - protein, 557 aa, Homo sapiens
MATAVSRPCAGRSRDILWRVLGWRIVASIVWSVLFLPICTTVFIIFSRIDLFHPIQWLSDSFSDLYSSYVIFYFLLLSVVIIIISIFNVEFYAVVPSIPCSRLALIGKIIHPQQLMHSFIHAAMGMVMAWCAAVITQGQYSFLVVPCTGTNSFGSPAAQTCLNEYHLFFLLTGAFMGYSYSLLYFVNNMNYLPFPIIQQYKFLRFRRSLLLLVKHSCVESLFLVRNFCILYYFLGYIPKAWISTAMNLHIDEQVHRPLDTVSGLLNLSLLYHVWLCGVFLLTTWYVSWILFKIYATEAHVFPVQPPFAEGSDECLPKVLNSNPPPIIKYLALQDLMLLSQYSPSRRQEVFSLSQPGGHPHNWTAISRECLNLLNEMTEFSNPSPSTSISAEGKTMRQPSVIYSWIQNKREQIKNFLSKRVLIMYFFSKHPEASIQAVFSDAQMHIWALEGLSHLVAASFTEDRFGVVQTTLPAILNTLLTLQEAVDKYFKLPHASSKPPRISGSLVDTSYKTLRFAFRASLKTAIYRITTTFGEHLNAVQASAEHQKRLQQFLEFKE

SEQ ID NO: 67849 - protein, 674 aa, Homo sapiens
MATAVSRPCAGRSRDILWRVLGWRIVASIVWSVLFLPICTTVFIIFSRIDLFHPIQWLSDSFSDLYSSYVIFYFLLLSVVIIIISIFNVEFYAVVPSIPCSRLALIGKIIHPQQLMHSFIHAAMGMVMAWCAAVITQGQYSFLVVPCTGTNSFGSPAAQTCLNEYHLFFLLTGAFMGYSYSLLYFVNNMNYLPFPIIQQYKFLRFRRSLLLLVKHSCVESLFLVRNFCILYYFLGYIPKAWISTAMNLHIDEQVHRPLDTVSGLLNLSLLYHVWLCGVFLLTTWYVSWILFKIYATEAHVFPVQPPFAEGSDECLPKVLNSNPPPIIKYLALQDLMLLSQYSPSRRQEVFSLSQPGGHPHNWTAISRECLNLLNGMTQKLILYQEAAATNGRVSSSYPVEPKKLNSPEETAFQTPKSSQMPRPSVPPLVKTSLFSSKLSTPDVVSPFGTPFGSSVMNRMAGIFDVNTCYGSPQSPQLIRRGPRLWTSASDQQMTEFSNPSPSTSISAEGKTMRQPSVIYSWIQNKREQIKNFLSKRVLIMYFFSKHPEASIQAVFSDAQMHIWALEGLSHLVAASFTEDRFGVVQTTLPAILNTLLTLQEAVDKYFKLPHASSKPPRISGSLVDTSYKTLRFAFRASLKTAIYRITTTFGEHLNAVQASAEHQKRLQQFLEFKE

SEQ ID NO: 67850 - protein, 339 aa, Homo sapiens
MLLSQYSPSRRQEVFSLSQPGGHPHNWTAISRECLNLLNGMTQKLILYQEAAATNGRVSSSYPVEPKKLNSPEETAFQTPKSSQMPRPSVPPLVKTSLFSSKLSTPDVVSPFGTPFGSSVMNRMAGIFDVNTCYGSPQSPQLIRRGPRLWTSASDQQMTEFSNPSPSTSISAEGKTMRQPSVIYSWIQNKREQIKNFLSKRVLIMYFFSKHPEASIQAVFSDAQMHIWALEGLSHLVAASFTEDRFGVVQTTLPAILNTLLTLQEAVDKYFKLPHASSKPPRISGSLVDTSYKTLRFAFRASLKTAIYRITTTFGEHLNAVQASAEHQKRLQQFLEFKE

SEQ ID NO: 67851 - protein, 542 aa, Homo sapiens
MATAVSRPCAGRSRDILWRVLGWRIVASIVWSVLFLPICTTVFIIFSRIDLFHPIQWLSDSFSDLYSSYVIFYFLLLSVVIIIISIFNVEFYAVVPSIPCSRLALIGKIIHPQQLMHSFIHAAMGMVMAWCAAVITQGQYSFLVVPCTGTNSFGSPAAQTCLNEYHLFFLLTGAFMGYSYSLLYFVNNMNYLPFPIIQQYKFLRFRRSLLLLVKHSCVESLFLVRNFCILYYFLGYIPKAWISTAMNLHIDEQVHRPLDTVSGLLNLSLLYHVWLCGVFLLTTWYVSWILFKIYATEAHVFPVQPPFAEGSDECLPKVLNSNPPPIIKYLALQDLMLLSQYSPSRRQEVFSLSQPGGHPHNWTAISRECLNLLNGMTQKLILYQEAAATNGRVSSSYPVEPKKLNSPEETAFQTPKSSQMPRPSVPPLVKTSLFSSKLSTPDVVSPFGTPFGSSVMNRMAGIFDVNTCYGSPQSPQLIRRGPRLWTSASDQQMTEFSNPSPSTSISAEAPRGLHSGCFFRCPNAYLGIRRSVALSSSIIYRG

SEQ ID NO: 67852 - protein, 443 aa, Homo sapiens
MRLTRKRLCSFLIALYCLFSLYAAYHVFFGRRRQAPAGSPRGLRKGAAPARERRGREQSTLESEEWNPWEGDEKNEQQHRFKTSLQILDKSTKGKTDLSVQIWGKAAIGLYLWEHIFEGLLDPSDVTAQWREGKSIVGRTQYSFITGPAVIPGYFSVDVNNVVLILNGREKAKIFYATQWLLYAQNLVQIQKLQHLAVVLLGNEHCDNEWINPFLKRNGGFVELLFIIYDSPWINDVDVFQWPLGVATYRNFPVVEASWSMLHDERPYLCNFLGTIYENSSRQALMNILKKDGNDKLCWVSAREHWQPQETNESLKNYQDALLQSDLTLCPVGVNTECYRIYEACSYGSIPVVEDVMTAGNCGNTSVHHGAPLQLLKSMGAPFIFIKNWKELPAVLEKEKTIILQEKIERRKMLLQWYQHFKTELKMKFTNILESSFLMNNKS

SEQ ID NO: 67853 - protein, 257 aa, Homo sapiens
MAADGVDERSPLLSASHSGNVTPTAPPYLQESSPRAELPPPYTAIASPDASGIPVINCRVCQSLINLDGKLHQHVVKCTVCNEATPIKNPPTGKKYVRCPCNCLLICKDTSRRIGCPRPNCRRIINLGPVMLISEEQPAQPALPIQPEGTRVVCGHCGNTFLWMELRFNTLAKCPHCKKISSVGSALPRRRCCAYITIGMICIFIGVGLTVGTPDFARRFRATYVSWAIAYLLGLICLIRACYWGAIRVSYPEHSFA

SEQ ID NO: 67854 - protein, 914 aa, Homo sapiens
MSLSHWPYFRLVLNFRPQVICLPQPPKVLGYRLEPPHLTLACTLEGMYNIIEEILERDINGTLLSQATCELCDGNENSFMVVNALGDRCVRCEPTFVNTSRSCACSEPNILTGGLCFSSTGNFPLRRISAARYGEVGMSLTSEWFAKYLQSSAAACWVYANLTSCQALGNMCVMNMNSYDFATFDACGLFQFIFENTAGLSTVHSISFWRQNLPWLFYGDQLGLAPQVLSSTSLPTNFSFKGENQNTKLKFVAASYDIRGNFLKWQTLEGGVLQLCPDTETRLNAAYSFGTTYQQNCEIPISKILIDFPTPIFYDVYLEYTDENQHQYILAVPVLNLNLQHNKIFVNQDSNSGKWLLTRRIFLVDAVSGRENDLGTQPRVIRVATQISLSVHLVPNTINGNIYPPLITIAYSDIDIKDANSQSVKVSFSVTYEMDHGEAHVQTDIALGVLGGLAVLASLLKTAGWKRRIGSPMIDLQTVVKFLVYYAGDLANVFFIITVGTGLYWLIFFKAQKSVSVLLPMPIQEERFVTYVGCAFALKALQFLHKLISQITIDVFFIDWERPKGKVLKAVEGEGGVRSATVPVSIWRTYFVANEWNEIQTVRKINSLFQVLTVLFFLEVVGFKNLALMDSSSSLSRNPPSYIAPYSCILRYAVSAALWLAIGIIQVVFFAVFYERFIEDKIRQFVDLCSMSNISVFLLSHKCFGYYIHGRSVHGHADTNMEEMNMNLKREAENLCSQRGLVPNTDGQTFEIAISNQMRQHYDRIHETLIRKNGPARLLSSSASTFEQSIKAYHMMNKFLGSFIDHVHKEMDYFIKDKLLLERILGMEFMEPMEKSIFYNDEGYSFSSVLYYGNEATLLIFDLLFFCVVDLACQNFILASFLTYLQQEIFRYIRNTVGQKNLASKTLVDQRFLI

SEQ ID NO: 67855 - protein, 995 aa, Homo sapiens
MATRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMKGVTEDGWNCISCPSDLTAEGKCHCPIGHILVERDINGTLLSQATCELCDGNENSFMVVNALGDRCVRCEPTFVNTSRSCACSEPNILTGGLCFSSTGNFPLRRISAARYGEVGMSLTSEWFAKYLQSSAAACWVYANLTSCQALGNMCVMNMNSYDFATFDACGLFQFIFENTAGLSTVHSISFWRQNLPWLFYGDQLGLAPQVLSSTSLPTNFSFKGENQNTKLKFVAASYDIRGNFLKWQTLEGGVLQLCPDTETRLNAAYSFGTTYQQNCEIPISKILIDFPTPIFYDVYLEYTDENQHQYILAVPVLNLNLQHNKIFVNQDSNSGKWLLTRRIFLVDAVSGRENDLGTQPRVIRVATQISLSVHLVPNTINGNIYPPLITIAYSDIDIKDANSQSVKVSFSVTYEMDHGEAHVQTDIALGVLGGLAVLASLLKTAGWKRRIGSPMIDLQTVVKFLVYYAGDLANVFFIITVGTGLYWLIFFKAQKSVSVLLPMPIQEERFVTYVGCAFALKALQFLHKLISQITIDVFFIDWERPKGKVLKAVEGEGGVRSATVPVSIWRTYFVANEWNEIQTVRKINSLFQVLTVLFFLEVVGFKNLALMDSSSSLSRNPPSYIAPYSCILRYAVSAALWLAIGIIQVVFFAVFYERFIEDKIRQFVDLCSMSNISVFLLSHKCFGYYIHGRSVHGHADTNMEEMNMNLKREAENLCSQRGLVPNTDGQTFEIAISNQMRQHYDRIHETLIRKNGPARLLSSSASTFEQSIKAYHMMNKFLGSFIDHVHKEMDYFIKDKLLLERILGMEFMEPMEKSIFYNDEGYSFSSVLYYGNEATLLIFDLLFFCVVDLACQNFILASFLTYLQQEIFRYIRNTVGQKNLASKTLVDQRFLI

SEQ ID NO: 67856 - protein, 260 aa, Homo sapiens
MLFLALGSPWAVELPLCGRRTALCAAAALRGPRASVSRASSSSGPSGPVAGWSTGPSGAARLLRRPGRAQIPVYWEGYVRFLNTPSDKSEDGRLIYTGNMARAVFGVKCFSYSTSLIGLTFLPYIFTQNNAISESVPLPIQIIFYGIMGSFTVITPVLLHFITKGYVIRLYHEATTDTYKAITYNAMLAETSTVFHQNDVKIPDAKHVFTTFYAKTKSLLVNPVLFPNREDYIHLMGYDKEEFILYMEETSEEKRHKDDK

SEQ ID NO: 67857 - protein, 107 aa, Homo sapiens
MLFLALGSPWAVELPLCGRRTALCAAAALRGPRASVSRASSSSGPSGPVAGWSTGPSGAARLLRRPGRAQIPVYWEGYVRFLNTPSDKSEDGRLIYTGNMARAVFGK

SEQ ID NO: 67858 - protein, 305 aa, Homo sapiens
MELHYLAKKSNQADLCDARDWSSRGLPGDQADTAATRAALCCQKQCASTPRATEMEGSKLSSSPASPSSSLQNSTLQPDAFPPGLLHSGNNQITAERKVCNCCSQELETSFTYVDKNINLEQRNRSSPSAKGHNHPGELGWENPNEWSQEAAISLISEEEDDTSSEATSSGKSIDYGFISAILFLVTGILLVIISYIVPREVTVDPNTVAAREMERLEKESARLGAHLDRCVIAGLCLLTLGGVILSCLLMMSMWKGELYRRNRFASSKESAKLYGSFNFRMKTSTNENTLELSLVEEDALAVQS

SEQ ID NO: 67859 - protein, 176 aa, Homo sapiens
MGAPATRRCVEWLLGLYFLSHIPITLFMDLQAVLPRELYPVEFRNLLKWYAKEFKDPLLQEPPAWFKSFLFCELVFQLPFFPIATYAFLKGSCKWIRTPAIIYSVHTMTTLIPILSTFLFEDFSKASGFKGQRPETLHERLTLVSVYAPYLLIPFILLIFMLRSPYYKYEEKRKKK

SEQ ID NO: 67860 - protein, 69 aa, Homo sapiens
MTTLIPILSTFLFEDFSKASGFKGQRPETLHERLTLVSVYAPYLLIPFILLIFMLRSPYYKYEEKRKKK

SEQ ID NO: 67861 - protein, 374 aa, Homo sapiens
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRKCPRSNRIHRQKQNTGHYSSDNTTRASTRLI

SEQ ID NO: 67862 - protein, 175 aa, Homo sapiens
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGGRSCLFTYLKIYWWILLCIFTYVCSISDI

SEQ ID NO: 67863 - protein, 808 aa, Homo sapiens
MAELLASAGSACSWDFPRAPPSFPPPAASRGGLGGTRSFRPHRGAESPRPGRDRDGVRVPMASSRCPAPRGCRCLPGASLAWLGTVLLLLADWVLLRTALPRIFSLLVPTALPLLRVWAVGLSRWAVLWLGACGVLRATVGSKSENAGAQGWLAALKPLAAALGLALPGLALFRELISWGAPGSADSTRLLHWGSHPTAFVVSYAAALPAAALWHKLGSLWVPGGQGGSGNPVRRLLGCLGSETRRLSLFLVLVVLSSLGEMAIPFFTGRLTDWILQDGSADTFTRNLTLMSILTIASAVLEFVGDGIYNNTMGHVHSHLQGEVFGAVLRQETEFFQQNQTGNIMSRVTEDTSTLSDSLSENLSLFLWYLVRGLCLLGIMLWGSVSLTMVTLITLPLLFLLPKKVGKWYQLLEVQVRESLAKSSQVAIEALSAMPTVRSFANEEGEAQKFREKLQEIKTLNQKEAVAYAVNSWTTSISGMLLKVGILYIGGQLVTSGAVSSGNLVTFVLYQMQFTQAVEVLLSIYPRVQKAVGSSEKIFEYLDRTPRCPPSGLLTPLHLEGLVQFQDVSFAYPNRPDVLVLQGLTFTLRPGEVTALVGPNGSGKSTVAALLQNLYQPTGGQLLLDGKPLPQYEHRYLHRQVAAVGQEPQVFGRSLQENIAYGLTQKPTMEEITAAAVKSGAHSFISGLPQGYDTEVDEAGSQLSGGQRQAVALARALIRKPCVLILDDATSALDANSQLQVEQLLYESPERYSRSVLLITQHLSLVEQADHILFLEGGAIREGGTHQQLMEKKGCYWAMVQAPADAPE

SEQ ID NO: 67864 - protein, 808 aa, Homo sapiens; identical to SEQ ID NO: 67863

SEQ ID NO: 67865 - protein, 808 aa, Homo sapiens; identical to SEQ ID NO: 67863

SEQ ID NO: 67866 - protein, 808 aa, Homo sapiens; identical to SEQ ID NO: 67863

SEQ ID NO: 67867 - protein, 808 aa, Homo sapiens; identical to SEQ ID NO: 67863

SEQ ID NO: 67868 - protein, 547 aa, Homo sapiens
MAIPFFTGRLTDWILQDGSADTFTRNLTLMSILTIASAVLEFVGDGIYNNTMGHVHSHLQGEVFGAVLRQETEFFQQNQTGNIMSRVTEDTSTLSDSLSENLSLFLWYLVRGLCLLGIMLWGSVSLTMVTLITLPLLFLLPKKVGKWYQLLEVQVRESLAKSSQVAIEALSAMPTVRSFANEEGEAQKFREKLQEIKTLNQKEAVAYAVNSWTTSISGMLLKVGILYIGGQLVTSGAVSSGNLVTFVLYQMQFTQAVEVLLSIYPRVQKAVGSSEKIFEYLDRTPRCPPSGLLTPLHLEGLVQFQDVSFAYPNRPDVLVLQGLTFTLRPGEVTALVGPNGSGKSTVAALLQNLYQPTGGQLLLDGKPLPQYEHRYLHRQVAAVGQEPQVFGRSLQENIAYGLTQKPTMEEITAAAVKSGAHSFISGLPQGYDTEVDEAGSQLSGGQRQAVALARALIRKPCVLILDDATSALDANSQLQVEQLLYESPERYSRSVLLITQHLSLVEQADHILFLEGGAIREGGTHQQLMEKKGCYWAMVQAPADAPE

SEQ ID NO: 67869 - protein, 808 aa, Homo sapiens
MAELLASAGSACSWDFPRAPPSFPPPAASRGGLGGTRSFRPHRGAESPRPGRDRDGVRVPMASSRCPAPRGCRCLPGASLAWLGTVLLLLADWVLLRTALPRIFSLLVPTALPLLRVWAVGLSRWAVLWLGACGVLRATGGSKSENAGAQGWLAALKPLAAALGLALPGLALFRELISWGAPGSADSTRLLHWGSHPTAFVVSYAAALPAAALWHKLGSLWVPGGQGGSGNPVRRLLGCLGSETRRLSLFLVLVVLSSLGEMAIPFFTGRLTDWILQDGSADTFTRNLTLMSILTIASAVLEFVGDGIYNNTMGHVHSHLQGEVFGAVLRQETEFFQQNQTGNIMSRVTEDTSTLSDSLSENLSLFLWYLVRGLCLLGIMLWGSVSLTMVTLITLPLLFLLPKKVGKWYQLLEVQVRESLAKSSQVAIEALSAMPTVRSFANEEGEAQKFREKLQEIKTLNQKEAVAYAVNSWTTSISGMLLKVGILYIGGQLVTSGAVSSGNLVTFVLYQMQFTQAVEVLLSIYPRVQKAVGSSEKIFEYLDRTPRCPPSGLLTPLHLEGLVQFQDVSFAYPNRPDVLVLQGLTFTLRPGEVTALVGPNGSGKSTVAALLQNLYQPTGGQLLLDGKPLPQYEHRYLHRQVAAVGQEPQVFGRSLQENIAYGLTQKPTMEEITAAAVKSGAHSFISGLPQGYDTEVDEAGSQLSGGQRQAVALARALIRKPCVLILDDATSALDANSQLQVEQLLYESPERYSRSVLLITQHLSLVEQADHILFLEGGAIREGGTHQQLMEKKGCYWAMVQAPADAPE

SEQ ID NO: 67870 - protein, 808 aa, Homo sapiens; identical to SEQ ID NO: 67863

SEQ ID NO: 67871 - protein, 808 aa, Homo sapiens; identical to SEQ ID NO: 67863

SEQ ID NO: 67872 - protein, 547 aa, Homo sapiens; identical to SEQ ID NO: 67868

SEQ ID NO: 67873 - protein, 547 aa, Homo sapiens; identical to SEQ ID NO: 67868

SEQ ID NO: 67874 - protein, 547 aa, Homo sapiens; identical to SEQ ID NO: 67868

SEQ ID NO: 67875 - protein, 547 aa, Homo sapiens; identical to SEQ ID NO: 67868

SEQ ID NO: 67876 - protein, 547 aa, Homo sapiens; identical to SEQ ID NO: 67868

SEQ ID NO: 67877 - protein, 547 aa, Homo sapiens; identical to SEQ ID NO: 67868

SEQ ID NO: 67878 - protein, 547 aa, Homo sapiens; identical to SEQ ID NO: 67868

SEQ ID NO: 67879 - protein, 686 aa, Homo sapiens
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLVRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNIAYGLQSCEDDKVMAAAQAAHADDFIQEMEHGIYTDVGEKGSQLAAGQKQRLAIARALVRDPRVLILDEATSALDVQCEQALQDWNSRGDRTVLVIAHRLQTVQRAHQILVLQEGKLQKLAQL

SEQ ID NO: 67880 - protein, 653 aa, Homo sapiens
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLVRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNIAYGLQSCEDDKVMAAAQAAHADDFIQEMEHGIYTDVGEKGSQLAAGQKQRLAIARALVRDPRVLILDEATSALDVQCEQAKTLWKFMIF

SEQ ID NO: 67881 - protein, 686 aa, Homo sapiens; identical to SEQ ID NO: 67879

SEQ ID NO: 67882 - protein, 653 aa, Homo sapiens; identical to SEQ ID NO: 67880

SEQ ID NO: 67883 - protein, 686 aa, Homo sapiens; identical to SEQ ID NO: 67879

SEQ ID NO: 67884 - protein, 653 aa, Homo sapiens; identical to SEQ ID NO: 67880

SEQ ID NO: 67885 - protein, 653 aa, Homo sapiens; identical to SEQ ID NO: 67880

SEQ ID NO: 67886 - protein, 686 aa, Homo sapiens
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLIRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNITYGLQSCEDDKVMAAAQAAHADDFIQEMEHGIYTDVGEKGSQLAAGQKQRLAIARALVRDPRVLILDEATSALDVQCEQALQDWNSRGDRTVLVIAHRLQTVQRAHQILVLQEGKLQKLAQL

SEQ ID NO: 67887 - protein, 653 aa, Homo sapiens; identical to SEQ ID NO: 67880

SEQ ID NO: 67888 - protein, 653 aa, Homo sapiens; identical to SEQ ID NO: 67880

SEQ ID NO: 67889 - protein, 686 aa, Homo sapiens; identical to SEQ ID NO: 67879

SEQ ID NO: 67890 - protein, 653 aa, Homo sapiens
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLIRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNITYGLQSCEDDKVMAAAQAAHADDFIQEMEHGIYTDVGEKGSQLAAGQKQRLAIARALVRDPRVLILDEATSALDVQCEQAKTLWKFMIF

SEQ ID NO: 67891 - protein, 653 aa, Homo sapiens; identical to SEQ ID NO: 67880

SEQ ID NO: 67892 - protein, 703 aa, Homo sapiens
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLVRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNIAYGLQSCEDDKVMAAAQAAHADDFIQEMEHGIYTDVGEKGSQLAAGQKQRLAIARALVRDPRVLILDEATSALDVQCEQALQDWNSRGDRTVLVIAHRLQAVQRAHQILVLQEGKLQKLAQLQEGQDLYSRLVQQRLMD

SEQ ID NO: 67893 - protein, 703 aa, Homo sapiens; identical to SEQ ID NO: 67892

SEQ ID NO: 67894 - protein, 703 aa, Homo sapiens; identical to SEQ ID NO: 67892

SEQ ID NO: 67895 - protein, 769 aa, Homo sapiens
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLVRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNIAYGLQSCEDDKVMAAAQAAHADDFIQEMEHGIYTDVGEKGSQLAAGQKQRLAIARALVRDPRVLILDEATSALDVQCEQANGFWVGPLGGGSASESDPTGFLHDSRHRLSSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQ

SEQ ID NO: 67896 - protein, 769 aa, Homo sapiens; identical to SEQ ID NO: 67895

SEQ ID NO: 67897 - protein, 769 aa, Homo sapiens; identical to SEQ ID NO: 67895

SEQ ID NO: 67898 - protein, 769 aa, Homo sapiens
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLIRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNITYGLQSCEDDKVMAAAQAAHADDFIQEMEHGIYTDVGEKGSQLAAGQKQRLAIARALVRDPRVLILDEATSALDVQCEQANGFWVGPLGGGSASESDPTGFLHDSRHRLSSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQ

SEQ ID NO: 67899 - protein, 769 aa, Homo sapiens; identical to SEQ ID NO: 67895

SEQ ID NO: 67900 - protein, 769 aa, Homo sapiens; identical to SEQ ID NO: 67895

SEQ ID NO: 67901 - protein, 898 aa, Homo sapiens
MVWDRQTKMEYEWKPDEQGLQQILQLLKESQSPDTTIQRTVQQKLEQLNQYPDFNNYLIFVLTKLKSEDEPTRSLSGLILKNNVKAHFQNFPNGVTDFIKSECLNNIGDSSPLIRATVGILITTIASKGELQNWPDLLPKLCSLLDSEDYNTCEGAFGALQKICEDSAEILDSDVLDRPLNIMIPKFLQFFKHSSPKIRSHAVACVNQFIISRTQALMLHIDSFIENLFALAGDEEPEVRKNVCRALVMLLEVRMDRLLPHMHNIVEYMLQRTQDQDENVALEACEFWLTLAEQPICKDVLVRHLPKLIPVLVNGMKYSDIDIILLKGDVEEDETIPDSEQDIRPRFHRSRTVAQQHDEDGIEEEDDDDDEIDDDDTISDWNLRKCSAAALDVLANVYRDELLPHILPLLKELLFHHEWVVKESGILVLGAIAEGCMQGMIPYLPELIPHLIQCLSDKKALVRSITCWTLSRYAHWVVSQPPDTYLKPLMTELLKRILDSNKRVQEAACSAFATLEEEACTELVPYLAYILDTLVFAFSKYQHKNLLILYDAIGTLADSVGHHLNKPEYIQMLMPPLIQKWNMLKDEDKDLFPLLECLSSVATALQSGFLPYCEPVYQRCVNLVQKTLAQAMLNNAQPDQYEAPDKDFMIVALDLLSGLAEGLGGNIEQLVARSNILTLMYQCMQDKMPEVRQSSFALLGDLTKACFQHVKPCIADFMPILGTNLNPEFISVCNNATWAIGEISIQMGIEMQPYIPMVLHQLVEIINRPNTPKTLLENTAITIGRLGYVCPQEVAPMLQQFIRPWCTSLRNIRDNEEKDSAFRGICTMISVNPSGVIQDFIFFCDAVASWINPKDDLRDMFCKILHGFKNQVGDENWRRFSDQFPLPLKERLAAFYGV

SEQ ID NO: 67902 - protein, 128 aa, Homo sapiens
MEYEWKPDEQGLQQILQLLKESQSPDTTIQRTVQQKLEQLNQYPDFNNYLIFVLTKLKSEDEPTRSLSGLILKNNVKAHFQNFPNGVTDFIKSECLNNIGDSSPLIRATVGLTLLHVSISLSSVGLKL

SEQ ID NO: 67903 - protein, 848 aa, Homo sapiens
MVWDRQTKMEYEWKPDEQGLQQILQLLKESQSPDTTIQRTVQQKLEQLNQYPDFNNYLIFVLTKLKSEGILITTIASKGELQNWPDLLPKLCSLLDSEDYNTCEGAFGALQKICEDSAEILDSDVLDRPLNIMIPKFLQFFKHSSPKIRSHAVACVNQFIISRTQALMLHIDSFIENLFALAGDEEPEVRKNVCRALVMLLEVRMDRLLPHMHNIVEYMLQRTQDQDENVALEACEFWLTLAEQPICKDVLVRHLPKLIPVLVNGMKYSDIDIILLKGDVEEDETIPDSEQDIRPRFHRSRTVAQQHDEDGIEEEDDDDDEIDDDDTISDWNLRKCSAAALDVLANVYRDELLPHILPLLKELLFHHEWVVKESGILVLGAIAEGCMQGMIPYLPELIPHLIQCLSDKKALVRSITCWTLSRYAHWVVSQPPDTYLKPLMTELLKRILDSNKRVQEAACSAFATLEEEACTELVPYLAYILDTLVFAFSKYQHKNLLILYDAIGTLADSVGHHLNKPEYIQMLMPPLIQKWNMLKDEDKDLFPLLECLSSVATALQSGFLPYCEPVYQRCVNLVQKTLAQAMLNNAQPDQYEAPDKDFMIVALDLLSGLAEGLGGNIEQLVARSNILTLMYQCMQDKMPEVRQSSFALLGDLTKACFQHVKPCIADFMPILGTNLNPEFISVCNNATWAIGEISIQMGIEMQPYIPMVLHQLVEIINRPNTPKTLLENTAITIGRLGYVCPQEVAPMLQQFIRPWCTSLRNIRDNEEKDSAFRGICTMISVNPSGVIQDFIFFCDAVASWINPKDDLRDMFCKILHGFKNQVGDENWRRFSDQFPLPLKERLAAFYGV

SEQ ID NO: 67904 - protein, 890 aa, Homo sapiens
MEYEWKPDEQGLQQILQLLKESQSPDTTIQRTVQQKLEQLNQYPDFNNYLIFVLTKLKSEDEPTRSLSGLILKNNVKAHFQNFPNGVTDFIKSECLNNIGDSSPLIRATVGILITTIASKGELQNWPDLLPKLCSLLDSEDYNTCEGAFGALQKICEDSAEILDSDVLDRPLNIMIPKFLQFFKHSSPKIRSHAVACVNQFIISRTQALMLHIDSFIENLFALAGDEEPEVRKNVCRALVMLLEVRMDRLLPHMHNIVEYMLQRTQDQDENVALEACEFWLTLAEQPICKDVLVRHLPKLIPVLVNGMKYSDIDIILLKGDVEEDETIPDSEQDIRPRFHRSRTVAQQHDEDGIEEEDDDDDEIDDDDTISDWNLRKCSAAALDVLANVYRDELLPHILPLLKELLFHHEWVVKESGILVLGAIAEGCMQGMIPYLPELIPHLIQCLSDKKALVRSITCWTLSRYAHWVVSQPPDTYLKPLMTELLKRILDSNKRVQEAACSAFATLEEEACTELVPYLAYILDTLVFAFSKYQHKNLLILYDAIGTLADSVGHHLNKPEYIQMLMPPLIQKWNMLKDEDKDLFPLLECLSSVATALQSGFLPYCEPVYQRCVNLVQKTLAQAMLNNAQPDQYEAPDKDFMIVALDLLSGLAEGLGGNIEQLVARSNILTLMYQCMQDKMPEVRQSSFALLGDLTKACFQHVKPCIADFMPILGTNLNPEFISVCNNATWAIGEISIQMGIEMQPYIPMVLHQLVEIINRPNTPKTLLENTAITIGRLGYVCPQEVAPMLQQFIRPWCTSLRNIRDNEEKDSAFRGICTMISVNPSGVIQDFIFFCDAVASWINPKDDLRDMFCKILHGFKNQVGDENWRRFSDQFPLPLKERLAAFYGV

SEQ ID NO: 67905 - protein, 887 aa, Homo sapiens
MDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIGILITTIASKGELQMWPELLPQLCNLLNSEDYNTCEGAFGALQKICEDSSELLDSDALNRPLNIMIPKFLQFFKHCSPKIRSHAIACVNQFIMDRAQALMDNIDTFIEHLFALAVDDDPEVRKNVCRALVMLLEVRIDRLIPHMHSIIQYMLQRTQDHDENVALEACEFWLTLAEQPICKEVLASHLVQLIPILVNGMKYSEIDIILLKGDVEEDEAVPDSEQDIKPRFHKSRTVTLPHEAERPDGSEDAEDDDDDDALSDWNLRKCSAAALDVLANVFREELLPHLLPLLKGLLFHPEWVVKESGILVLGAIAEGCMQGMVPYLPELIPHLIQCLSDKKALVRSIACWTLSRYAHWVVSQPPDMHLKPLMTELLKRILDGNKRVQEAACSAFATLEEEACTELVPYLSYILDTLVFAFGKYQHKNLLILYDAIGTLADSVGHHLNQPEYIQKLMPPLIQKWNELKDEDKDLFPLLECLSSVATALQSGFLPYCEPVYQRCVTLVQKTLAQAMMYTQHPEQYEAPDKDFMIVALDLLSGLAEGLGGHVEQLVARSNIMTLLFQCMQDSMPEVRQSSFALLGDLTKACFIHVKPCIAEFMPILGTNLNPEFISVCNNATWAIGEICMQMGAEMQPYVQMVLNNLVEIINRPNTPKTLLENTAITIGRLGYVCPQEVAPMLQQFIRPWCTSLRNIRDNEEKDSAFRGICMMIGVNPGGVVQDFIFFCDAVASWVSPKDDLRDMFYKILHGFKDQVGEDNWQQFSEQFPPLLKERLAAFYGV

SEQ ID NO: 67906 - protein, 699 aa, Homo sapiens
MDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIGILITTIASKGELQMWPELLPQLCNLLNSEDYNTCEGAFGALQKICEDSSELLDSDALNRPLNIMIPKFLQFFKHCSPKIRSHAIACVNQFIMDRAQALMDNIDTFIEHLFALAVDDDPEVRKNVCRALVMLLEVRIDRLIPHMHSIIQYMLQRTQDHDENVALEACEFWLTLAEQPICKEVLASHLVQLIPILVNGMKYSEIDIILLKGDVEEDEAVPDSEQDIKPRFHKSRTVTLPHEAERPDGSEDAEDDDDDDALSDWNLRKCSAAALDVLANVFREELLPHLLPLLKGLLFHPEWVVKESGILVLGAIAEGCMQGMVPYLPELIPHLIQCLSDKKALVRSIACWTLSRYAHWVVSQPPDMHLKPLMTELLKRILDGNKRVQEAACSAFATLEEEACTELVPYLSYILDTLVFAFGKYQHKNLLILYDAIGTLADSVGHHLNQPEYIQKLMPPLIQKWNELKDEDKDLFPLLECLSSVATALQSGFLPYCEPVYQRCVTLVQKTLAQAMMYTQHPEQYEAPDKDFMIVALDLLSGLAEGLGGHVEQLVAHSPSFPPHPLPPAGSRVCPFVTVLCWGLAPRWREIPLV

SEQ ID NO: 67907 - protein, 897 aa, Homo sapiens
MDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIGILITTIASKGELQMWPELLPQLCNLLNSEDYNTCEGAFGALQKICEDSSELLDSDALNRPLNIMIPKFLQFFKHCSPKIRSHAIACVNQFIMDRAQALMDNIDTFIEHLFALAVDDDPEVRKNVCRALVMLLEVRIDRLIPHMHSIIQYMLQRTQDHDENVALEACEFWLTLAEQPICKEVLASHLVQLIPILVNGMKYSEIDIILLKGDVEEDEAVPDSEQDIKPRFHKSRTVTLPHEAERPDGSEDAEDDDDDDALSDWNLRKCSAAALDVLANVFREELLPHLLPLLKGLLFHPEWVVKESGILVLGAIAEGCMQGMVPYLPELIPHLIQCLSDKKALVRSIACWTLSRYAHWVVSQPPDMHLKPLMTELLKRILDGNKRVQEAACSAFATLEEEACTELVPYLSYILDTLVFAFGKYQHKNLLILYDAIGTLADSVGHHLNQPEYIQKLMPPLIQKWNELKDEDKDLFPLLECLSSVATALQSGFLPYCEPVYQRCVTLVQKTLAQAMMYTQHPEQYEAPDKDFMIVALDLLSGLAEGLGGHVEQLVARSNIMTLLFQCMQDSMPEVRQSSFALLGDLTKACFIHVKPCIAEFMPILGTNLNPEFISVCNNATWAIGEICMQMGAEMQPYVQMVLNNLVEIINRPNTPKTLLENTGRLTSPSAIPAITIGRLGYVCPQEVAPMLQQFIRPWCTSLRNIRDNEEKDSAFRGICMMIGVNPGGVVQDFIFFCDAVASWVSPKDDLRDMFYKILHGFKDQVGEDNWQQFSEQFPPLLKERLAAFYGV

SEQ ID NO: 67908 - protein, 887 aa, Homo sapiens; identical to SEQ ID NO: 67905

SEQ ID NO: 67909 - protein, 897 aa, Homo sapiens; identical to SEQ ID NO: 67907

SEQ ID NO: 67910 - protein, 1051 aa, Homo sapiens
GQSVGGRGLFRDCACIEETTGAGALSRSGAGPLDVEAAGPSPSRCEGGGSLRARSRGQRHGPPWDEGSSLGPMRIRRAPPPPPVARFHIPPPALPSPRLRGRGWRSWRGPRTWAGVDRRPPPVRRGRSRRHAATAASGAPPGSHTEPQRPSADPGPYLRSLPCAMDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIGILITTIASKGELQMWPELLPQLCNLLNSEDYNTCEGAFGALQKICEDSSELLDSDALNRPLNIMIPKFLQFFKHCSPKIRSHAIACVNQFIMDRAQALMDNIDTFIEHLFALAVDDDPEVRKNVCRALVMLLEVRIDRLIPHMHSIIQYMLQRTQDHDENVALEACEFWLTLAEQPICKEVLASHLVQLIPILVNGMKYSEIDIILLKGDVEEDEAVPDSEQDIKPRFHKSRTVTLPHEAERPDGSEDAEDDDDDDALSDWNLRKCSAAALDVLANVFREELLPHLLPLLKGLLFHPEWVVKESGILVLGAIAEGCMQGMVPYLPELIPHLIQCLSDKKALVRSIACWTLSRYAHWVVSQPPDMHLKPLMTELLKRILDGNKRVQEAACSAFATLEEEACTELVPYLSYILDTLVFAFGKYQHKNLLILYDAIGTLADSVGHHLNQPEYIQKLMPPLIQKWNELKDEDKDLFPLLECLSSVATALQSGFLPYCEPVYQRCVTLVQKTLAQAMMYTQHPEQYEAPDKDFMIVALDLLSGLAEGLGGHVEQLVARSNIMTLLFQCMQDSMPEVRQSSFALLGDLTKACFIHVKPCIAEFMPILGTNLNPEFISVCNNATWAIGEICMQMGAEMQPYVQMVLNNLVEIINRPNTPKTLLENTAITIGRLGYVCPQEVAPMLQQFIRPWCTSLRNIRDNEEKDSAFRGICMMIGVNPGGVVQDFIFFCDAVASWVSPKDDLRDMFYKILHGFKDQVGEDNWQQFSEQFPPLLKERLAAFYGV

SEQ ID NO: 67911 - protein, 771 aa, Homo sapiens
MDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIGILITTIASKGELQMWPELLPQLCNLLNSEDYNTCEGAFGALQKICEDSSELLDSDALNRPLNIMIPKFLQFFKHCSPKIRSHAIACVNQFIMDRAQALMDNIDTFIEHLFALAVDDDPEVRKNVCRALVMLLEVRIDRLIPHMHSIIQYMLQRTQDHDENVALEACEFWLTLAEQPICKEVLASHLVQLIPILVNGMKYSEIDIILLKGDVEEDEAVPDSEQDIKPRFHKSRTVTLPHEAERPDGSEDAEDDDDDDALSDWNLRKCSAAALDVLANVFREELLPHLLPLLKGLLFHPEWVVKESGILVLGAIAEGCMQGMVPYLPELIPHLIQCLSDKKALVRSIACWTLSRYAHWVVSQPPDMHLKPLMTELLKRILDGNKRVQEAACSAFATLEEEACTELVPYLSYILDTLVFAFGKYQHKNLLILYDAIGTLADSVGHHLNQPEYIQKLMPPLIQKWNELKDEDKDLFPLLECLSSVATALQSGFLPYCEPVYQRCVTLVQKTLAQAMMYTQHPEQYEAPDKDFMIVALDLLSGLAEGLGGHVEQLVARSNIMTLLFQCMQDSMPEVRQSSFALLGDLTKACFIHVKPCIAEFMPILGTNLNPEFISVCNNATWAIGEICMQMGAEMQPYVQMVLNNLVEIINRPTPSQKQNKTKKNK

SEQ ID NO: 67912 - protein, 923 aa, Homo sapiens
MEGAKPTLQLVYQAVQALYHDPDPSGKERASFWLGELQRSVHAWEISDQLLQIRQDVESCYFAAQTMKMKIQTSFYELPTDSHASLRDSLLTHIQNLKDLSPVIVTQLALAIADLALQMPSWKGCVQTLVEKYSNDVTSLPFLLEILTVLPEEVHSRSLRIGANRRTEIIEDLAFYSSTVVSLLMTCVEKAGTDEKMLMKVFRCLGSWFNLGVLDSNFMANNKLLALLFEVLQQDKTSSNLHEAASDCVCSALYAIENVETNLPLAMQLFQGVLTLETAYHMAVAREDLDKVLNYCRIFTELCETFLEKIVCTPGQGLGDLRTLELLLICAGHPQYEVVEISFNFWYRLGEHLYKTNDEVIHGIFKAYIQRLLHALARHCQLEPDHEGVPEETDDFGEFRMRVSDLVKDLIFLIGSMECFAQLYSTLKEGNPPWEVTEAVLFIMAAIAKSVDPENNPTLVEVLEGVVRLPETVHTAVRYTSIELVGEMSEVVDRNPQFLDPVLGYLMKGLCEKPLASAAAKAIHNICSVCRDHMAQHFNGLLEIARSLDSFLLSPEAAVGLLKGTALVLARLPLDKITECLSELCSVQVMALKKLLSQEPSNGISSDPTVFLDRLAVIFRHTNPIVENGQTHPCQKVIQEIWPVLSETLNKHRADNRIVERCCRCLRFAVRCVGKGSAALLQPLVTQMVNVYHVHQHSCFLYLGSILVDEYGMEEGCRQGLLDMLQALCIPTFQLLEQQNGLQNHPDTVDDLFRLATRFIQRSPVTLLRSQVVIPILQWAIASTTLDHRDANCSVMRFLRDLIHTGVANDHEEDFELRKELIGQVMNQLGQQLVSQLLHTCCFCLPPYTLPDVAEVLWEIMQVDRPTFCRWLENSLKGLPKETTVGAVTVTHKQLTDFHKQVTSAEECKQVCWALRDFTRLFR

SEQ ID NO: 67913 - protein, 957 aa, Homo sapiens
MEGAKPTLQLVYQAVQALYHDPDPSGKERASFWLGELQRSVHAWEISDQLLQIRQDVESCYFAAQTMKMKIQTSFYELPTDSHASLRDSLLTHIQNLKDLSPVIVTQLALAIADLALQMPSWKGCVQTLVEKYSNDVTSLPFLLEILTVLPEEVHSRSLRIGANRRTEIIEDLAFYSSTVVSLLMTCVEKAGTDEKMLMKVFRCLGSWFNLGVLDSNFMANNKLLALLFEVLQQDKTSSNLHEAASDCVCSALYAIENVETNLPLAMQLFQGVLTLETAYHMAVAREDLDKVLNYCRIFTELCETFLEKIVCTPGQGLGDLRTLELLLICAGHPQYEVVEISFNFWYRLGEHLYKTNDEVIHGIFKAYIQRLLHALARHCQLEPDHEGVPEETDDFGEFRMRVSDLVKDLIFLIGSMECFAQLYSTLKEGNPPWEVTEAVLFIMAAIAKSVDPKKPFSNAVCRHSLLFGQNITSEISNCEYLPPVLRENNPTLVEVLEGVVRLPETVHTAVRYTSIELVGEMSEVVDRNPQFLDPVLGYLMKGLCEKPLASAAAKAIHNICSVCRDHMAQHFNGLLEIARSLDSFLLSPEAAVGLLKGTALVLARLPLDKITECLSELCSVQVMALKKLLSQEPSNGISSDPTVFLDRLAVIFRHTNPIVENGQTHPCQKVIQEIWPVLSETLNKHRADNRIVERCCRCLRFAVRCVGKGSAALLQPLVTQMVNVYHVHQHSCFLYLGSILVDEYGMEEGCRQGLLDMLQALCIPTFQLLEQQNGLQNHPDTVDDLFRLATRFIQRSPVTLLRSQVVIPILQWAIASTTLDHRDANCSVMRFLRDLIHTGVANDHEEDFELRKELIGQVMNQLGQQLVSQLLHTCCFCLPPYTLPDVAEVLWEIMQVDRPTFCRWLENSLKGLPKETTVGAVTVTHKQLTDFHKQVTSAEECKQVCWALRDFTRLFR

SEQ ID NO: 67914 - protein, 957 aa, Homo sapiens; identical to SEQ ID NO: 67913

SEQ ID NO: 67915 - protein, 859 aa, Homo sapiens
MEGAKPTLQLVYQAVQALYHDPDPSGKERASFWLGELQRSVHAWEISDQLLQIRQDVESCYFAAQTMKMKIQTSFYELPTDSHASLRDSLLTHIQNLKDLSPVIVTQLALAIADLALQMPSWKGCVQTLVEKYSNDVTSLPFLLEILTVLPEEVHSRSLRIGANRRTEIIEDLAFYSSTVVSLLMTCVEKAGTDEKMLMKVFRCLGSWFNLGVLDSNFMANNKLLALLFEVLQQDKTSSNLHEAASDCVCSALYAIENVETNLPLAMQLFQGVLTLETAYHMAVAREDLDKVLNYCRIFTELCETFLEKIVCTPGQGLGDLRTLELLLICAGHPQYEVVEISFNFWYRLGEHLYKTNDEVIHGIFKAYIQRLLHALARHCQLEPDHEGVPEETDDFGEFRMRVSDLVKDLIFLIGSMECFAQLYSTLKEGNPPWEVTEAVLFIMAAIAKSVDPENNPTLVEVLEGVVRLPETVHTAVRYTSIELVGEMSEVVDRNPQFLGTALVLARLPLDKITECLSELCSVQVMALKKLLSQEPSNGISSDPTVFLDRLAVIFRHTNPIVENGQTHPCQKVIQEIWPVLSETLNKHRADNRIVERCCRCLRFAVRCVGKGSAALLQPLVTQMVNVYHVHQHSCFLYLGSILVDEYGMEEGCRQGLLDMLQALCIPTFQLLEQQNGLQNHPDTVDDLFRLATRFIQRSPVTLLRSQVVIPILQWAIASTTLDHRDANCSVMRFLRDLIHTGVANDHEEDFELRKELIGQVMNQLGQQLVSQLLHTCCFCLPPYTLPDVAEVLWEIMQVDRPTFCRWLENSLKGLPKETTVGAVTVTHKQLTDFHKQVTSAEECKQVCWALRDFTRLFR

SEQ ID NO: 67916 - protein, 1411 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEELQKGMGTVEGGDQSNPKSKKEKKKSDKRKKDKEKKEKKKKAKKASTKDSESPSQKKKKKKKKTAEQTV

SEQ ID NO: 67917 - protein, 1489 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLVGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEELQKGMGTVEGGDQSNPKSKKEKKKSDKRKKDKEKKEKKKKAKKASTKDSESPSQKKKKKKKKTAEQTV

SEQ ID NO: 67918 - protein, 958 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQDQESS

SEQ ID NO: 67919 - protein, 1414 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVDSAVGTLPATSPQSTSVQAKGTNKLRKPKLPEVQQATKAPESSDDSEDSSDSSSGSEEDGEGPQGAKSAHTLGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEELQKGMGTVEGGDQSNPKSKKEKKKSDKRKKDK

SEQ ID NO: 67920 - protein, 1451 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVDSAVGTLPATSPQSTSVQAKGTNKLRKPKLPEVQQATKAPESSDDSEDSSDSSSGSEEDGEGPQGAKSAHTLVGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEELQKGMGTVEGGDQSNPKSKKEKKKSDKRKKDKEKKEKKKKAKKASTKDSESPSQKKKKKKKKTAEQTV

SEQ ID NO: 67921 - protein, 1412 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLVGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEELQKGMGTVEGGDQSNPKSKKEKKKSDKRKKDKEKKEKKKKAKKASTKDSESPSQKKKKKKKKTAEQTV

SEQ ID NO: 67922 - protein, 1525 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQKDSNSKPARSKTLAPAPPERNTEGSSESSEEELPLTQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEELQKGMGTVEGGDQSNPKSKKEKKKSDKRKKDKEKKEKKKKAKKASTKDSESPSQKKKKKKKKTAEQTV

SEQ ID NO: 67923 - protein, 1488 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEELQKGMGTVEGGDQSNPKSKKEKKKSDKRKKDKEKKEKKKKAKKASTKDSESPSQKKKKKKKKTAEQTV

SEQ ID NO: 67924 - protein, 84 aa, Homo sapiens
MATMENKVICALVLVSMLALGTLAEAQTETCTVAPRERQNCGFPGVTPSQCANKGCCFDDTVRGVPWCFYPNTIDVPPEEECEF

SEQ ID NO: 67925 - protein, 129 aa, Homo sapiens
MGRRDAQLLAALLVLGLCALAGSEKPSPCQCSRLSPHNRTNCGFPGITSDQCFDNGCCFDSSVTGVPWCFHPLPKQESDQCVMEVSDRRNCGYPGISPEECASRKCCFSNFIFEVPWCFFPKSVEDCHY

SEQ ID NO: 67926 - protein, 582 aa, Homo sapiens
MPGRTWELCLLLLLGLGLGSQEALPPPCESEIYCHGELLNQVQMAKLYQDDKQFVDMPLSIAPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYWDSYWVMEGLLLSEMAETVKGMLQNFLDLVKTYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWTNGVVLMLLDRYGDRLTSGPKLPFLEPHCLATLLPSLLLSLLPW

SEQ ID NO: 67927 - protein, 551 aa, Homo sapiens
MPGRTWELCLLLLLGLGLGSQEALPPPCESEIYCHGELLNQVQMAKLYQDDKQFVDMPLSIAPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYCYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWTNGVVLMLLDRYGDRLTSGPKLPFLEPHCLATLLPSLLLSLLPW

SEQ ID NO: 67928 - protein, 459 aa, Homo sapiens
MPNCVPGQGSCISSGRSWGRRYQRPGPAQGLTKGTEERNVPGAHSVFGAQIRDSYWVMEGLLLSEMAETVKGMLQNFLDLVKTYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWTNGVVLMLLDRYGDRLTSGPKLPFLEPHCLATLLPSLLLSLLPW

SEQ ID NO: 67929 - protein, 546 aa, Homo sapiens
MPGRTWELCLLLLLGLGLGSQEALPPPCESEIYCHGELLNQVQMAKLYQDDKQFVDMPLSIAPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYCYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWTNGVVLMLLDRYGDRLTSGPKLPFLEPHCLGPPFCPASC

SEQ ID NO: 67930 - protein, 577 aa, Homo sapiens
MPGRTWELCLLLLLGLGLGSQEALPPPCESEIYCHGELLNQVQMAKLYQDDKQFVDMPLSIAPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYWDSYWVMEGLLLSEMAETVKGMLQNFLDLVKTYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWTNGVVLMLLDRYGDRLTSGPKLPFLEPHCLGPPFCPASC

SEQ ID NO: 67931 - protein, 90 aa, Homo sapiens
MEETTDWIYGFFSLLSDIISSEDEEDDDGDEDTDKGEIDEPPLRKKEIHKDKTEKQEKPERKIQTKDWSANSSTIRTLKLTQLKPIYICT

SEQ ID NO: 67932 - protein, 217 aa, Homo sapiens
MEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKGFPGPGIRNSSYYCQYIKGQINAWNDLRTSLLPIPYLSCGKMCSNFNN

SEQ ID NO: 67933 - protein, 721 aa, Homo sapiens
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKDQYAFCRYMIDIFVHGDLKPGQSPAIPPPLPTEQASRPTPASPALEEKEGEKKKAEKKVTSETKKKEKEDIKKKSEKETAIDVEKKEPGKASETKQGTVKIAAQAAAKKDEKKEDSKKTKKPAEVEQPKGKKQEKKEKHVEPAKSPKKEHSVPSDKQVKAKTERAKEEIGAVSIKKAVPGKKEEKTTKTVEQEIRKEKSGKTSSILKDKEPIKGKEEKVPASLKEKEPETKKDEKMSKAGKEVKPKPPQLQGKKEEKPEPQIKKEAKPAISEKVQIHKQDIVKPEKTVSHGKPEEKVLKQVKAVTIEKTAKPKPTKKAEHREREPPSIKTDKPKPTPKGTSEVTESGKKKTEISEKESKEKADMKHLREEKVSTRKESLQLHNVTKEDVEDVPASKKAKEGTEDVSPTKQKSPISFFQCVYLDGYNGYGFQFPFTPADRPGESSGQANSPGQKQQGQ

SEQ ID NO: 67934 - protein, 26 aa, Homo sapiens
  MOD_RES (1)..(1): Any amino acid
XIHKDKTEKQEKPERKIQTKEVGHSS

SEQ ID NO: 67935 - protein, 151 aa, Homo sapiens
  MOD_RES (1)..(1): Any amino acid
XTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKGFPGPGIRNSSYYCQYIKGQINAWNDLRTSLLPIPYLSCGKMCSNFNN

SEQ ID NO: 67936 - protein, 731 aa, Homo sapiens
IVEIYPQGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKDQYAFCRYMIDIFVHGDLKPGQSPAIPPPLPTEQASRPTPASPALEEKEGEKKKAEKKVTSETKKKEKEDIKKKSEKETAIDVEKKVQEPGKASETKQGTVKIAAQAAAKKDEKKEDSKKTKKPAEVEQPKGKKQEKKEKHVEPAKSPKKEHSVPSDKQVKAKTERAKEEIGAVSIKKAVPGKKEEKTTKTVEQEIRKEKSGKTSSILKDKEPIKGKEEKVPASLKEKEPETKKDEKMSKAGKEVKPKPPQLQGKKEEKPEPQIKKEAKPAISEKVQIHKQDIVKPEKTVSHGKPEEKVLKQVKAVTIEKTAKPKPTKKAEHREREPPSIKTDKPKPTPKGTSEVTESGKKKTEISEKESKEKADMKHLREEKVSTRKESLQLHNVTKAEEVDSTLEDVEDVPASKKAKEGTEDVSPTKQKSPISFFQCVYLDGYNGYGFQFPFTPADRPGESSGQANSPGQKQQGQ

SEQ ID NO: 67937 - protein, 729 aa, Homo sapiens
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKDQYAFCRYMIDIFVHGDLKPGQSPAIPPPLPTEQASRPTPASPALEEKEGEKKKAEKKVTSETKKKEKEDIKKKSEKETAIDVEKKEPGKASETKQGTVKIAAQAAAKKDEKKEDSKKTKKPAEVEQPKGKKQEKKEKHVEPAKSPKKEHSVPSDKQVKAKTERAKEEIGAVSIKKAVPGKKEEKTTKTVEQEIRKEKSGKTSSILKDKEPIKGKEEKVPASLKEKEPETKKDEKMSKAGKEVKPKPPQLQGKKEEKPEPQIKKEAKPAISEKVQIHKQDIVKPEKTVSHGKPEEKVLKQVKAVTIEKTAKPKPTKKAEHREREPPSIKTDKPKPTPKGTSEVTESGKKKTEISEKESKEKADMKHLREEKVSTRKESLQLHNVTKAEKPARVSKDVEDVPASKKAKEGTEDVSPTKQKSPISFFQCVYLDGYNGYGFQFPFTPADRPGESSGQANSPGQKQQGQ

SEQ ID NO: 67938 - protein, 44 aa, Homo sapiens
  MOD_RES (1)..(1): Any amino acid
XIHKDKTEKQEKPERKIQTKDWSANSSTIRTLKLTQLKPIYICT

SEQ ID NO: 67939 - protein, 345 aa, Homo sapiens
IVEIYPQGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKDQYAFCRYMIDIFVHGDLKPGQSPAIPPPLPTEQASRPTPASPALEEKEGEKKKAEKKVTSETKKKEKEDIKKKKKKKKKK

SEQ ID NO: 67940 - protein, 167 aa, Homo sapiens
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKEVGHSS

SEQ ID NO: 67941 - protein, 328 aa, Homo sapiens
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKDQYAFCRYMIDIFVHGDLKPGQSPAIPPPLPTEQASRPTPASPALEGDKASKEKKRKMKRMSEK

SEQ ID NO: 67942 - protein, 297 aa, Homo sapiens
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKGQSPAIPPPLPTEQASRPTPASPALEGKYFFFS

SEQ ID NO: 67943 - protein, 1943 aa, Homo sapiens
MSPLLRSICDITEIFNQYVSHDCDGAALTKKDLKNLLEREFGAVLRRPHDPKTVDLILELLDLDSNGRVDFNEFLLFIFKVAQACYYALGQATGLDEEKRARCDGKESLLQDRRQEEDQRRFEPRDRQLEEEPGQRRRQKRQEQERELAEGEEQSEKQERLEQRDRQRRDEELWRQRQEWQEREERRAEEEQLQSCKGHETEEFPDEEQLRRRELLELRRKGREEKQQQRRERQDRVFQEEEEKEWRKRETVLRKEEEKLQEEEPQRQRELQEEEEQLRKLERQELRRERQEEEQQQQRLRREQQLRRKQEEERREQQEERREQQERREQQEERREQQLRREQEERREQQLRREQEEERREQQLRREQEEERREQQLRREQQLRREQQLRREQQLRREQQLRREQQLRREQQLRREQQLRREQQLRREQEEERHEQKHEQERREQRLKREQEERRDWLKREEETERHEQERRKQQLKRDQEEERRERWLKLEEEERREQQERREQQLRREQEERREQRLKRQEEEERLQQRLRSEQQLRREQEERREQLLKREEEKRLEQERREQRLKREQEERRDQLLKREEERRQQRLKREQEERLEQRLKREEVERLEQEERREQRLKREEPEEERRQQLLKSEEQEERRQQQLRREQQERREQRLKREEEEERLEQRLKREHEEERREQELAEEEQEQARERIKSRIPKWQWQLESEADARQSKVYSRPRKQEGQRRRQEQEEKRRRRESELQWQEEERAHRQQQEEEQRRDFTWQWQAEEKSERGRQRLSARPPLREQRERQLRAEERQQREQRFLPEEEEKEQRRRQRREREKELQFLEEEEQLQRRERAQQLQEEEDGLQEDQERRRSQEQRRDQKWRWQLEEERKRRRHTLYAKPALQEQLRKEQQLLQEEEEELQREEREKRRRQEQERQYREEEQLQQEEEQLLREEREKRRRQERERQYRKDKKLQQKEEQLLGEEPEKRRRQEREKKYREEEELQQEEEQLLREEREKRRRQEWERQYRKKDELQQEEEQLLREEREKRRLQERERQYREEEELQQEEEQLLGEERETRRRQELERQYRKEEELQQEEEQLLREEPEKRRRQERERQCREEEELQQEEEQLLREEREKRRRQELERQYREEEEVQQEEEQLLREEPEKRRRQELERQYREEEELQQEEEQLLREEQEKRRQERERQYREEEELQRQKRKQRYRDEDQRSDLKWQWEPEKENAVRDNKVYCKGRENEQFRQLEDSQLRDRQSQQDLQHLLGEQQERDREQERRRWQQRDRHFPEEEQLEREEQKEAKRRDRKSQEEKQLLREEREEKRRRQETDRKFREEEQLLQEREEQPLRRQERDRKFREEELRHQEQGRKFLEEEQRLRRQERERKFLKEEQQLRCQEREQQLRQDRDRKFREEEQQLSRQERDRKFREEEQQVRRQERERKFLEEEQQLRQERHRKFREEEQLLQEREEQQLHRQERDRKFLEEEQQLRRQERDRKFREQELRSQEPERKFLEEEQQLHRQQRQRKFLQEEQQLRRQERGQQRRQDRDRKFREEEQLRQEREEQQLSRQERDRKFRLEEQKVRRQEQERKFMEDEQQLRRQEGQQQLRQERDRKFREDEQLLQEREEQQLHRQERDRKFLEEEPQLRRQEREQQLRHDRDRKFREEEQLLQEGEEQQLRRQERDRKFREEEQQLRRQERERKFLQEEQQLRRQELERKFREEEQLRQETEQEQLRRQERYRKILEEEQLRPEREEQQLRRQERDRKFREEEQLRQEREEQQLRSQESDRKFREEEQLRQEREEQQLRPQQRDGKYRWEEEQLQLEEQEQRLRQERDRQYRAEEQFATQEKSRREEQELWQEEEQKRRQERERKLREEHIRRQQKEEQRHRQVGEIKSQEGKGHGRLLEPGTHQFASVPVRSSPLYEYIQEQRSQYRP

SEQ ID NO: 67944 - protein, 1281 aa, Homo sapiens
MVRKKNPPLRNVASEGEGQILEPIGTESKVSGKNKEFSADQMSENTDQSDAAELNHKEEHSLHVQDPSSSSKKDLKSAVLSEKAGFNYESPSKGGNFPSFPHDEVTDRNMLAFSSPAAGGVCEPLKSPQRAEADDPQDMACTPSGDSLETKEDQKMSPKATEETGQAQSGQANCQGLSPVSVASKNPQVPSDGGVRLNKSKTDLLVNDNPDPAPLSPELQDFKCNICGYGYYGNDPTDLIKHFRKYHLGLHNRTRQDAELDSKILALHNMVQFSHSKDFQKVNRSVFSGVLQDINSSRPVLLNGTYDVQVTSGGTFIGIGRKTPDCQGNTKYFRCKFCNFTYMGNSSTELEQHFLQTHPNKIKASLPSSEVAKPSEKNSNKSIPALQSSDSGDLGKWQDKITVKAGDDTPVGYSVPIKPLDSSRQNGTEATSYYWCKFCSFSCESSSSLKLLEHYGKQHGAVQSGGLNPELNDKLSRGSVINQNDLAKSSEGETMTKTDKSSSGAKKKDFSSKGAEDNMVTSYNCQFCDFRYSKSHGPDVIVVGPLLRHYQQLHNIHKCTIKHCPFCPRGLCSPEKHLGEITYPFACRKSNCSHCALLLLHLSPGAAGSSRVKHQCHQCSFTTPDVDVLLFHYESVHESQASDVKQEANHLQGSDGQQSVKESKEHSCTKCDFITQVEEEISRHYRRAHSCYKCRQCSFTAADTQSLLEHFNTVHCQEQDITTANGEEDGHAISTIKEEPKIDFRVYNLLTPDSKMGEPVSESVVKREKLEEKDGLKEKVWTESSSDDLRNVTWRGADILRGSPSYTQASLGLLTPVSGTQEQTKTLRDSPNVEAAHLARPIYGLAVETKGFLQGAPAGGEKSGALPQQYPASGENKSKDESQSLLRRRRGSGVFCANCLTTKTSLWRKNANGGYVCNACGLYQKLHSTPRPLNIIKQNNGEQIIRRRTRKRLNPEALQAEQLNKQQRGSNEEQVNGSPLERRSEDHLTESHQREIPLPSLSKYEAQGSLTKSHSAQQPVLVSQTLDIHKRMQPLHIQIKSPQESTGDPGNSSSVSEGKGSSERGSPIEKYMRPAKHPNYSPPGSPIEKYQYPLFGLPFVHNDFQSEADWLRFWSKYKLSVPGNPHYLSHVPGLPNPCQNYVPYPTFNLPPHFSAVGSDNDIPLDLAIKHSRPGPTANGASKEKTKAPPNVKNEGPLNVVKTEKVDRSTQDELSTKCVHCGIVFLDEVMYALHMSCHGDSGPFQCSICQHLCTDKYDFTTHIQRGLHRNNAQVEKNGKPKE

SEQ ID NO: 67945 - protein, 1294 aa, Homo sapiens
MPYEVNAGYDFTNMVRKKNPPLRNVASEGEGQILEPIGTESKVSGKNKEFSADQMSENTDQSDAAELNHKEEHSLHVQDPSSSSKKDLKSAVLSEKAGFNYESPSKGGNFPSFPHDEVTDRNMLAFSSPAAGGVCEPLKSPQRAEADDPQDMACTPSGDSLETKEDQKMSPKATEETGQAQSGQANCQGLSPVSVASKNPQVPSDGGVRLNKSKTDLLVNDNPDPAPLSPELQDFKCNICGYGYYGNDPTDLIKHFRKYHLGLHNRTRQDAELDSKILALHNMVQFSHSKDFQKVNRSVFSGVLQDINSSRPVLLNGTYDVQVTSGGTFIGIGRKTPDCQGNTKYFRCKFCNFTYMGNSSTELEQHFLQTHPNKIKASLPSSEVAKPSEKNSNKSIPALQSSDSGDLGKWQDKITVKAGDDTPVGYSVPIKPLDSSRQNGTEATSYYWCKFCSFSCESSSSLKLLEHYGKQHGAVQSGGLNPELNDKLSRGSVINQNDLAKSSEGETMTKTDKSSSGAKKKDFSSKGAEDNMVTSYNCQFCDFRYSKSHGPDVIVVGPLLRHYQQLHNIHKCTIKHCPFCPRGLCSPEKHLGEITYPFACRKSNCSHCALLLLHLSPGAAGSSRVKHQCHQCSFTTPDVDVLLFHYESVHESQASDVKQEANHLQGSDGQQSVKESKEHSCTKCDFITQVEEEISRHYRRAHSCYKCRQCSFTAADTQSLLEHFNTVHCQEQDITTANGEEDGHAISTIKEEPKIDFRVYNLLTPDSKMGEPVSESVVKREKLEEKDGLKEKVWTESSSDDLRNVTWRGADILRGSPSYTQASLGLLTPVSGTQEQTKTLRDSPNVEAAHLARPIYGLAVETKGFLQGAPAGGEKSGALPQQYPASGENKSKDESQSLLRRRRGSGVFCANCLTTKTSLWRKNANGGYVCNACGLYQKLHSTPRPLNIIKQNNGEQIIRRRTRKRLNPEALQAEQLNKQQRGSNEEQVNGSPLERRSEDHLTESHQREIPLPSLSKYEAQGSLTKSHSAQQPVLVSQTLDIHKRMQPLHIQIKSPQESTGDPGNSSSVSEGKGSSERGSPIEKYMRPAKHPNYSPPGSPIEKYQYPLFGLPFVHNDFQSEADWLRFWSKYKLSVPGNPHYLSHVPGLPNPCQNYVPYPTFNLPPHFSAVGSDNDIPLDLAIKHSRPGPTANGASKEKTKAPPNVKNEGPLNVVKTEKVDRSTQDELSTKCVHCGIVFLDEVMYALHMSCHGDSGPFQCSICQHLCTDKYDFTTHIQRGLHRNNAQVEKNGKPKE

SEQ ID NO: 67946 - protein, 1285 aa, Homo sapiens
MQSNMVRKKNPPLRNVASEGEGQILEPIGTESKVSGKNKEFSADQMSENTDQSDAAELNHKEEHSLHVQDPSSSSKKDLKSAVLSEKAGFNYESPSKGGNFPSFPHDEVTDRNMLAFSSPAAGGVCEPLKSPQRAEADDPQDMACTPSGDSLETKEDQKMSPKATEETGQAQSGQANCQGLSPVSVASKNPQVPSDGGVRLNKSKTDLLVNDNPDPAPLSPELQDFKCNICGYGYYGNDPTDLIKHFRKYHLGLHNRTRQDAELDSKILALHNMVQFSHSKDFQKVNRSVFSGVLQDINSSRPVLLNGTYDVQVTSGGTFIGIGRKTPDCQGNTKYFRCKFCNFTYMGNSSTELEQHFLQTHPNKIKASLPSSEVAKPSEKNSNKSIPALQSSDSGDLGKWQDKITVKAGDDTPVGYSVPIKPLDSSRQNGTEATSYYWCKFCSFSCESSSSLKLLEHYGKQHGAVQSGGLNPELNDKLSRGSVINQNDLAKSSEGETMTKTDKSSSGAKKKDFSSKGAEDNMVTSYNCQFCDFRYSKSHGPDVIVVGPLLRHYQQLHNIHKCTIKHCPFCPRGLCSPEKHLGEITYPFACRKSNCSHCALLLLHLSPGAAGSSRVKHQCHQCSFTTPDVDVLLFHYESVHESQASDVKQEANHLQGSDGQQSVKESKEHSCTKCDFITQVEEEISRHYRRAHSCYKCRQCSFTAADTQSLLEHFNTVHCQEQDITTANGEEDGHAISTIKEEPKIDFRVYNLLTPDSKMGEPVSESVVKREKLEEKDGLKEKVWTESSSDDLRNVTWRGADILRGSPSYTQASLGLLTPVSGTQEQTKTLRDSPNVEAAHLARPIYGLAVETKGFLQGAPAGGEKSGALPQQYPASGENKSKDESQSLLRRRRGSGVFCANCLTTKTSLWRKNANGGYVCNACGLYQKLHSTPRPLNIIKQNNGEQIIRRRTRKRLNPEALQAEQLNKQQRGSNEEQVNGSPLERRSEDHLTESHQREIPLPSLSKYEAQGSLTKSHSAQQPVLVSQTLDIHKRMQPLHIQIKSPQESTGDPGNSSSVSEGKGSSERGSPIEKYMRPAKHPNYSPPGSPIEKYQYPLFGLPFVHNDFQSEADWLRFWSKYKLSVPGNPHYLSHVPGLPNPCQNYVPYPTFNLPPHFSAVGSDNDIPLDLAIKHSRPGPTANGASKEKTKAPPNVKNEGPLNVVKTEKVDRSTQDELSTKCVHCGIVFLDEVMYALHMSCHGDSGPFQCSICQHLCTDKYDFTTHIQRGLHRNNAQVEKNGKPKE

SEQ ID NO: 67947 - protein, 234 aa, Homo sapiens
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRVPVFNIVILLAGGFLSKSLVFSVLFAVTLRSFVP

SEQ ID NO: 67948 - protein, 150 aa, Homo sapiens
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFRCSTLSFSWLVDS

SEQ ID NO: 67949 - protein, 225 aa, Homo sapiens
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRYSFQVPGPLVWTLSPLFPSLCAERM

SEQ ID NO: 67950 - protein, 166 aa, Homo sapiens
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRAERHV

SEQ ID NO: 67951 - protein, 230 aa, Homo sapiens
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRSLLEGEIPFPPTSILLLLACIFLIKILAASALWAAAWHGQKPGTHPPSELDCGHDPGYQLQTLPGLRDT

SEQ ID NO: 67952 - protein, 219 aa, Homo sapiens
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRAERHVKEDDGRKSPGEVPPGTSPACILATWPPGLLVLLWQETTLPEHCFSWTLEAGTG

SEQ ID NO: 67953 - protein, 311 aa, Homo sapiens
MGLTLLLLLLLGLEGQGIVGSLPEVLQAPVGSSILVQCHYRLQDVKAQKVWCRFLPEGCQPLVSSAVDRRAPAGRRTFLTDLGGGLLQVEMVTLQEEDAGEYGCMVDGARGPQILHRVSLNILPPEEEEETHKIGSLAENAFSDPAGSANPLEPSQDEKSIPLIWGAVLLVGLLVAAVVLFAVMAKRKQGNRLGVCGRFLSSRVSGMNPSSVVHHVSDSGPAAELPLDVPHIRLDSPPSFDNTTYTSLPLDSPSGKPSLPAPSSLPPLPPKVLVCSKPVTYATVIFPGGNKGGGTSCGPAQNPPNNQTPSS

SEQ ID NO: 67954 - protein, 199 aa, Homo sapiens
MGLTLLLLLLLGLEGQGIVGSLPEVLQAPVGSSILVQCHYRLQDVKAQKVWCRFLPEGCQPLVSSAVDRRAPAGRRTFLTDLGGGLLQVEMVTLQEEDAGEYGCMVDGARGPQILHRVSLNILPPEEEEETHKIGSLAENAFSDPAGSANPLEPSQDEKSIPLIWGAVLLVGLLVAAVVLFAVMAKRKQESLLSGPPRQ

SEQ ID NO: 67955 - protein, 200 aa, Homo sapiens
MGLTLLLLLLLGLEEEEEETHKIGSLAENAFSDPAGSANPLEPSQDEKSIPLIWGAVLLVGLLVAAVVLFAVMAKRKQGNRLGVCGRFLSSRVSGMNPSSVVHHVSDSGPAAELPLDVPHIRLDSPPSFDNTTYTSLPLDSPSGKPSLPAPSSLPPLPPKVLVCSKPVTYATVIFPGGNKGGGTSCGPAQNPPNNQTPSS

SEQ ID NO: 67956 - protein, 321 aa, Homo sapiens
MAPAFLLLLLLWPQGCVSGPSADSVYTKVRLLEGETLSVQCSYKGYKNRVEGKVWCKIRKKKCEPGFARVWVKGPRYLLQDDAQAKVVNITMVALKLQDSGRYWCMRNTSGILYPLMGFQLDVSPAPQTERNIPFTHLDNILKSGTVTTGQAPTSGPDAPFTTGVMVFTPGLITLPRLLASTRPASKTGYSFTATSTTSQGPRRTMGSQTVTASPSNARDSSAGPESISTKSGDLSTRSPTTGLCLTSRSLLNRLPSMPSIRHQDVYSTVLGVVLTLLVLMLIMVYGFWKKRHMASYSMCSDPSTRDPPGRPEPYVEVYLI

SEQ ID NO: 67957 - protein, 853 aa, Homo sapiens
MCCEKWSRVAEMFLFIEEREDCKILCLCSRAFVEDRKLYNLGLKGYYIRDSGNNSGDQATEEEEGGYSCGTAESHDSKGIGLDESELDSEAELMRSMGLPLQFGRITAHKDFEVSMNTRNKVKIKKKKHQKKYLDEIVQESWRKEYEEDDILASDDPSSIEQYENTRTYELQSKKDTETENPPVENTLSPKLEITEKWEKYWNEYGGGLLWQSWQEKHPGQALSSEPWNFPDTKEEWEQHYSQLYWYYLEQFQYWEAQGWTFDASQSCDTDTYTSKTEADDKNDEKCMKVDLVSFPSSPIMVDNDSSGTSDKDHSEILDGISNIKLNSEEVTQSQLDSCTSHDGHQQLSEVSSKRECPASGQSEPRNGGTNEESNSSGNTNTDPPAEDSQKSSGANTSKDRPHASGTDGDESEEDPPEHKPSKLKRSHELDIDENPASDFDDSGSLLGFKYGSGQKYGGIPNFSHRQVRYLEKNVKLKSKYLDMRRQIKMKNKHIFFTKESEKPFFKKSKILSKVEKFLTWVNKPMDEEASQESSSHDNVHDASTSSDSEEQDMSVKKGDDLLETNNPEPEKCQSVSSAGELETENYERDSLLATVPDEQDCVTQEVPDSRQAETEAEVKKKKNKKKNKKVNGLPPEIAAVPELAKYWAQRYRLFSRFDDGIKLDREGWFSVTPEKIAEHIAGRVSQSFKCDVVVDAFCGVGGNTIQFALTGMRVIAIDIDPVKIALARNNAEVYGIADKIEFICGDFLLLASFLKADVVFLSPPWGGPDYATAETFDIRTMMSPDGFEIFRLSKKITNNIVYFLPRNADIDQVASLAGPGGQVEIEQNFLNNKLKTITAYFGDLIRRPASET

SEQ ID NO: 67958 - protein, 421 aa, Homo sapiens
MWYHRLSHLHSRLQDLLKGGVIYPALPQPNFKSLLPLAVHWHHTASKSLTCAWQQHEDHFELKYANTVMRFDYVWLRDHCRSASCYNSKTHQRSLDTASVDLCIKPKTIRLDETTLFFTWPDGHVTKYDLNWLVKNSYEGQKQKVIQPRILWNAEIYQQAQVPSVDCQSFLETNEGLKKFLQNFLLYGIAFVENVPPTQEHTEKLAERISLIRETIYGRMWYFTSDFSRGDTAYTKLALDRHTDTTYFQEPCGIQVFHCLKHEGTGGRTLLVDGFYAAEQVLQKAPEEFELLSKVPLKHEYIEDVGECHNHMIGIGPVLNIYPWNKELYLIRYNNYDRAVINTVPYDVVHRWYTAHRTLTIELRRPENEFWVKLKPGRVLFIDNWRVLHGRECFTGYRQLCGCYLTRDDVLNTARLLGLQA

SEQ ID NO: 67959 - protein, 376 aa, Homo sapiens
MWYHRLSHLHSRLQDLLKGGVIYPALPQPNFKSLLPLAVHWHHTASKSLTCAWQQHEDHFELKYANTVMRFDYVWLRDHCRSASCYNSKTHQRSLDTASVDLCIKPKTIRLDETTLFFTWPDGHVTKYDLNWLVKNSYEGQKQKVIQPRILWNAEIYQQAQVPSVDCQSFLETNEGLKKFLQNFLLYGIAFVENVPPTQEHTEKLAERISLIRETIYGRMWYFTSDFSRGDTAYTKLALDRHTDTTYFQEPCGIQVFHCLKHEGTGGRTLLVDGFYAAEQVLQKAPEEFELLSKVPLKHEYIEDVGECHNHMIGIGPVLNIYPWNKELYLIRLFKEKQNTVNRQWNSSLQCDIPERILTYRHFVSGTSIEHRGSLI

SEQ ID NO: 67960 - protein, 1962 aa, Homo sapiens
MRELEAKATKDVERNLSRDLVQEEEQLMEEKKKKKDDKKKKEAAQKKATEQKIKVPEQIKPSVSQPQPANSNNGTSTATSTNNNAKRATANNQQPQQQQQQQQPQQQQPQQQPQPQPQQQQPQQQPQALPRYPREVPPRFRHQEHKQLLKRGQHFPVIAANLGSAVKVLNSQSESSALTNQQPQNNGEVQNSKNQSDINHSTSGSHYENSQRGPVSSTSDSSTNCKNAVVSDLSEKEAWPSAPGSDPELASECMDADSASSSESERNITIMASGNTGGEKDGLRNSTGLGSQNKFVVGSSSNNVGHGSSTGPWGFSHGAIISTCQVSVDAPESKSESSNNRMNAWGTVSSSSNGGLNPSTLNSASNHGAWPVLENNGLALKGPVGSGSSGINIQCSTIGQMPNNQSINSKVSGGSTHGTWGSLQETCESEVSGTQKVSFSGQPQNITTEMTGPNNTTNFMTSSLPNSGSVQNNELPSSNTGAWRVSTMNHPQMQAPSGMNGTSLSHLSNGESKSGGSYGTTWGAYGSNYSGDKCSGPNGQANGDTVNATLMQPGVNGPMGTNFQVNTNKGGGVWESGAANSQSTSWGSGNGANSGGSRRGWGTPAQNTGTNLPSVEWNKLPSNQHSNDSANGNGKTFTNGWKSTEEEDQGSATSQTNEQSSVWAKTGGTVESDGSTESTGRLEEKGTGESQSRDRRKIDQHTLLQSIVNRTDLDPRVLSNSGWGQTPIKQNTAWDTETSPRGERKTDNGTEAWGSSATQTFNSGACIDKTSPNGNDTSSVSGWGDPKPALRWGDSKGSNCQGGWEDDSAATGMVKSNQWGNCKEEKAAWNDSQKNKQGWGDGQKSSQGWSVSASDNWGETSRNNHWGEANKKSSSGGSDSDRSVSGWNELGKTSSFTWGNNINPNNSSGWDESSKPTPSQGWGDPPKSNQSLGWGDSSKPVSSPDWNKQQDIVGSWGIPPATGKPPGTGWLGGPIPAPAKEEEPTGWEEPSPESIRRKMEIDDGTSAWGDPSKYNYKNVNMWNKNVPNGNSRSDQQAQVHQLLTPASAISNKEASSGSGWGEPWGEPSTPATTVDNGTSAWGKPIDSGPSWGEPIAAASSTSTWGSSSVGPQALSKSGPKSMQDGWCGDDMPLPGNRPTGWEEEEDVEIGMWNSNSSQELNSSLNWPPYTKKMSSKGLSGKKRRRERGMMKGGNKQEEAWINPFVKQFSNISFSRDSPEENVQSNKMDLSGGMLQDKRMEIDKHSLNIGDYNRTVGKGPGSRPQISKESSMERNPYFDKDGIVADESQNMQFMSSQSMKLPPSNSALPNQALGSIAGLGMQNLNSVRQNGNPSMFGVGNTAAQPRGMQQPPAQPLSSSQPNLRAQVPPPLLSPQVPVSLLKYAPNNGGLNPLFGPQQVAMLNQLSQLNQLSQISQLQRLLAQQQRAQSQRSVPSGNRPQQDQQGRPLSVQQQMMQQSRQLDPNLLVKQQTPPSQQQPLHQPAMKSFLDNVMPHTTPELQKGPSPINAFSNFPIGLNSNLNVNMDMNSIKEPQSRLRKWTTVDSISVNTSLDQNSSKHGAISSGFRLEESPFVPYDFMNSSTSPASPPGSIGDGWPRAKSPNGSSSVNWPPEFRPGEPWKGYPNIDPETDPYVTPGSVINNLSINTVREVDHLRDRNSGSSSSLNTTLPSTSAWSSIRASNYNVPLSSTAQSTSARNSDSKLTWSPGSVTNTSLAHELWKVPLPPKNITAPSRPPPGLTGQKPPLSTWDNSPLRIGGGWGNSDARYTPGSSWGESSSGRITNWLVLKNLTPQIDGSTLRTLCMQHGPLITFHLNLPHGNALVRYSSKEEVVKAQKSLHMCVLGNTTILAEFASEEEISRFFAQSQSLTPSPGWQSLGSSQSRLGSLDCSHSFSSRTDLNHWNGAGLSGTNCGDLHGTSLWGTPHYSTSLWGPPSSSDPRGISSPSPINAFLSVDHLGGGGESM

SEQ ID NO: 67961 - protein, 440 aa, Homo sapiens
MDMNSIKEPQSRLRKWTTVDSISVNTSLDQNSSKHGAISSGFRLEESPFVPYDFMNSSTSPASPPGSIGDGWPRAKSPNGSSSVNWPPEFRPGEPWKGYPNIDPETDPYVTPGSVINNLSINTVREVDHLRDRNSGSSSSLNTTLPSTSAWSSIRASNYNVPLSSTAQSTSARNSDSKLTWSPGSVTNTSLAHELWKVPLPPKNITAPSRPPPGLTGQKPPLSTWDNSPLRIGGGWGNSDARYTPGSSWGESSSGRITNWLVLKNLTPQIDGSTLRTLCMQHGPLITFHLNLPHGNALVRYSSKEEVVKAQKSLHMCVLGNTTILAEFASEEEISRFFAQSQSLTPSPGWQSLGSSQSRLGSLDCSHSFSSRTDLNHWNGAGLSGTNCGDLHGTSLWGTPHYSTSLWGPPSSSDPRGISSPSPINAFLSVDHLGGGGESM

SEQ ID NO: 67962 - protein, 1690 aa, Homo sapiens
MATGSAQGNFTGHTKKTNGNNGTNGALVQSPSNQSALGAGGANSNGSAARVWGVATGSSSGLAHCSVSGGDGKMDTMIGDGRSQNCWGASNSNAGINLNLNPNANPAAWPVLGHEGTVATGNPSSICSPVSAIGQNMGNQNGNPTGTLGAWGNLLPQESTEPQTSTSQNVSFSAQPQNLNTDGPNNTNPMNSSPNPINAMQTNGLPNWGMAVGMGAIIPPHLQGLPGANGSSVSQVSGGSAEGISNSVWGLSPGNPATGNSNSGFSQGNGDTVNSALSAKQNGSSSAVQKEGSGGNAWDSGPPAGPGILAWGRGSGNNGVGNIHSGAWGHPSRSTSNGVNGEWGKPPNQHSNSDINGKGSTGWESPSVTSQNPTVQPGGEHMNSWAKAASSGTTASEGSSDGSGNHNEGSTGREGTGEGRRRDKGIIDQGHIQLPRNDLDPRVLSNTGWGQTPVKQNTAWEFEESPRSERKNDNGTEAWGCAATQASNSGGKNDGSIMNSTNTSSVSGWVNAPPAAVPANTGWGDSNNKAPSGPGVWGDSISSTAVSTAAAAKSGHAWSGAANQEDKSPTWGEPPKPKSQHWGDGQRSNPAWSAGGGDWADSSSVLGHLGDGKKNGSGWDADSNRSGSGWNDTTRSGNSGWGNSTNTKANPGTNWGETLKPGPQQNWASKPQDNNVSNWGGAASVKQTGTGWIGGPVPVKQKDSSEATGWEEPSPPSIRRKMEIDDGTSAWGDPSNYNNKTVNMWDRNNPVIQSSTTTNTTTTTTTTTSNTTHRVETPPPHQAGTQLNRSPLLGPGRKVSSGWGEMPNVHSKTENSWGEPSSPSTLVDNGTAAWGKPPSSGSGWGDHPAEPPVAFGRAGAPVAASALCKPASKSMQEGWGSGGDEMNLSTSQWEDEEGDVWNNAASQESTSSCSSWGNAPKKGLQKGMKTSGKQDEAWIMSRLIKQLTDMGFPREPAEEALKSNNMNLDQAMSALLEKKVDVDKRGLGVTDHNGMAAKPLGCRPPISKESSVDRPTFLDKDGGLVEEPTPSPFLPSPSLKLPLSHSALPSQALGGIASGLGMQNLNSSRQIPSGNLGMFGNSGAAQARTMQQPPQPPVQPLNSSQPSLRAQVPQFLSPQVQAQLLQFAAKNIGLNPALLTSPINPQHMTMLNQLYQLQLAYQRLQIQQQMLQAQRNVSGSMRQQEQQVARTITNLQQQIQQHQRQLAQALLVKQPPPPPPPPHLSLHPSAGKSAMDSFPSHPQTPGLPDLQTKEQQSSPNTFAPYPLAGLNPNMNVNSMDMTGGLSVKDPSQSQSRLPQWTHPNSMDNLPSAASPLEQNPSKHGAIPGGLSIGPPGKSSIDDSYGRYDLIQNSESPASPPVAVPHSWSRAKSDSDKISNGSSINWPPEFHPGVPWKGLQNIDPENDPDVTPGSVPTGPTINTTIQDVNRYLLKSGGKLSDIKSTWSSGPTSHTQASLSHELWKVPRNSTAPTRPPPGLTNPKPSSTWGASPLGWTSSYSSGSAWSTDTSGRTSSWLVLRNLTPQIDGSTLRTLCLQHGPLITFHLNLTQGNAVVRYSSKEEAAKAQKSLHMCVLGNTTILAEFAGEEEVNRFLAQGQALPPTSSWQSSSASSQPRLSAAGSSHGLVRSDAGHWNAPCLGGKGSSELLWGGVPQYSSSLWGPPSADDSRVIGSPTPLTTLLPGDLLSGESL

SEQ ID NO: 67963 - protein, 1726 aa, Homo sapiens
MATGSAQGNFTGHTKKTNGNNGTNGALVQSPSNQSALGAGGANSNGSAARVWGVATGSSSGLAHCSVSGGDGKMDTMIGDGRSQNCWGASNSNAGINLNLNPNANPAAWPVLGHEGTVATGNPSSICSPVSAIGQNMGNQNGNPTGTLGAWGNLLPQESTEPQTSTSQNVSFSAQPQNLNTDGPNNTNPMNSSPNPINAMQTNGLPNWGMAVGMGAIIPPHLQGLPGANGSSVSQVSGGSAEGISNSVWGLSPGNPATGNSNSGFSQGNGDTVNSALSAKQNGSSSAVQKEGSGGNAWDSGPPAGPGILAWGRGSGNNGVGNIHSGAWGHPSRSTSNGVNGEWGKPPNQHSNSDINGKGSTGWESPSVTSQNPTVQPGGEHMNSWAKAASSGTTASEGSSDGSGNHNEGSTGREGTGEGRRRDKGIIDQGHIQLPRNDLDPRVLSNTGWGQTPVKQNTAWEFEESPRSERKNDNGTEAWGCAATQASNSGGKNDGSIMNSTNTSSVSGWVNAPPAAVPANTGWGDSNNKAPSGPGVWGDSISSTAVSTAAAAKSGHAWSGAANQEDKSPTWGEPPKPKSQHWGDGQRSNPAWSAGGGDWADSSSVLGHLGDGKKNGSGWDADSNRSGSGWNDTTRSGNSGWGNSTNTKANPGTNWGETLKPGPQQNWASKPQDNNVSNWGGAASVKQTGTGWIGGPVPVKQKDSSEATGWEEPSPPSIRRKMEIDDGTSAWGDPSNYNNKTVNMWDRNNPVIQSSTTTNTTTTTTTTTSNTTHRVETPPPHQAGTQLNRSPLLGPVSSGWGEMPNVHSKTENSWGEPSSPSTLVDNGTAAWGKPPSSGSGWGDHPAEPPVAFGRAGAPVAASALCKPASKSMQEGWGSGGDEMNLSTSQWEDEEGDVWNNAASQESTSSCSSWGNAPKKGLQKGMKTSGKQDEAWIMSRLIKQLTDMGFPREPAEEALKSNNMNLDQAMSALLEKKVDVDKRGLGVTDHNGMAAKPLGCRPPISKESSVDRPTFLDKDGGLVEEPTPSPFLPSPSLKLPLSHSALPSQALGGIASGLGMQNLNSSRQIPSGNLGMFGNSGAAQARTMQQPPQPPVQPLNSSQPSLRAQVPQFLSPQVQAQLLQFAAKNIGLNPALLTSPINPQHMTMLNQLYQLQLAYQRLQIQQQMLQAQRNVSGSMRQQEQQVARTITNLQQQIQQHQRQLAQALLVKQPPPPPPPPHLSLHPSAGKSAMDSFPSHPQTPGLPDLQTKEQQSSPNTFAPYPLAGLNPNMNVNSMDMTGGLSVKDPSQSQSRLPQWTHPNSMDNLPSAASPLEQNPSKHGAIPGGLSIGPPGKSSIDDSYGRYDLIQNSESPASPPVAVPHSWSRAKSDSDKISNGSSINWPPEFHPGVPWKGLQNIDPENDPDVTPGSVPTGPTINTTIQDVNRYLLKSGGSSPPSSQNATLPSSSAWPLSASGYSSSFSSIASAPSVAGKLSDIKSTWSSGPTSHTQASLSHELWKVPRNSTAPTRPPPGLTNPKPSSTWGASPLGWTSSYSSGSAWSTDTSGRTSSWLVLRNLTPQIDGSTLRTLCLQHGPLITFHLNLTQGNAVVRYSSKEEAAKAQKSLHMCVLGNTTILAEFAGEEEVNRFLAQGQALPPTSSWQSSSASSQPRLSAAGSSHGLVRSDAGHWNAPCLGGKGSSELLWGGVPQYSSSLWGPPSADDSRVIGSPTPLTTLLPGDLLSGESL

SEQ ID NO: 67964 - protein, 1726 aa, Homo sapiens; identical to SEQ ID NO: 67963

SEQ ID NO: 67965 - protein, 1690 aa, Homo sapiens; identical to SEQ ID NO: 67962

SEQ ID NO: 67966 - protein, 1690 aa, Homo sapiens; identical to SEQ ID NO: 67962

SEQ ID NO: 67967 - protein, 1726 aa, Homo sapiens; identical to SEQ ID NO: 67963

SEQ ID NO: 67968 - protein, 652 aa, Homo sapiens
MGGWKGPGQRRGKEGPEARRRAAERGGGGGGGGVPAPRSPAREPRPRSCLLLPPPWGAAMTPDLLNFKKGWMSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEKEVQALRAQLEAWRLQGEAPQSALRSQEDGHIPPGYISQEACERSLAEMESSHQQVMEELQRHHERELQRLQQEKEWLLAEETAATASAIEAMKKAYQEELSRELSKTRSLQQGPDGLRKQHQSDVEALKRELQVLSEQYSQKCLEIGALMRQAEEREHTLRRCQQEGQELLRHNQELHGRLSEEIDQLRGFIASQGMGNGCGRSNERSSCELEVLLRVKENELQYLKKEVQCLRDELQMMQKDKRFTSGKYQDVYVELSHIKTRSEREIEQLKEHLRLAMAALQEKESMRNSLAE

SEQ ID NO: 67969 - protein, 2365 aa, Homo sapiens
MEEVPGDALCEHFEANILTQNRCQNCFHPEEAHGARYQELRSPSGAEVPYCDLPRCPPAPEDPLSASTSGCQSVVDPGLRPGPKRGPSPSAGLPEEGPTAAPRSRSRELEAVPYLEGLTTSLCGSCNEDPGSDPTSSPDSATPDDTSNSSSVDWDTVERQEEEAPSWDELAVMIPRRPREGPRADSSQRAPSLLTRSPVGGDAAGQKKEDTGGGGRSAGQHWARLRGESGLSLERHRSTLTQASSMTPHSGPRSTTSQASPAQRDTAQAASTREIPRASSPHRITQRDTSRASSTQQEISRASSTQQETSRASSTQEDTPRASSTQEDTPRASSTQWNTPRASSPSRSTQLDNPRTSSTQQDNPQTSFPTCTPQRENPRTPCVQQDDPRASSPNRTTQRENSRTSCAQRDNPKASRTSSPNRATRDNPRTSCAQRDNPRASSPSRATRDNPTTSCAQRDNPRASRTSSPNRATRDNPRTSCAQRDNPRASSPSRATRDNPTTSCAQRDNPRASRTSSPNRATRDNPRTSCAQRDNPRASSPNRAARDNPTTSCAQRDNPRASRTSSPNRATRDNPRTSCAQRDNPRASSPNRATRDNPTTSCAQRDNPRASRTSSPNRATRDNPRTSCAQRDNPRASSPNRTTQQDSPRTSCARRDDPRASSPNRTIQQENPRTSCALRDNPRASSPSRTIQQENPRTSCAQRDDPRASSPNRTTQQENPRTSCARRDNPRASSRNRTIQRDNPRTSCAQRDNPRASSPNRTIQQENLRTSCTRQDNPRTSSPNRATRDNPRTSCAQRDNLRASSPIRATQQDNPRTCIQQNIPRSSSTQQDNPKTSCTKRDNLRPTCTQRDRTQSFSFQRDNPGTSSSQCCTQKENLRPSSPHRSTQWNNPRNSSPHRTNKDIPWASFPLRPTQSDGPRTSSPSRSKQSEVPWASIALRPTQGDRPQTSSPSRPAQHDPPQSSFGPTQYNLPSRATSSSHNPGHQSTSRTSSPVYPAAYGAPLTSPEPSQPPCAVCIGHRDAPRASSPPRYLQHDPFPFFPEPRAPESEPPHHEPPYIPPAVCIGHRDAPRASSPPRHTQFDPFPFLPDTSDAEHQCQSPQHEPLQLPAPVCIGYRDAPRASSPPRQAPEPSLLFQDLPRASTESLVPSMDSLHECPHIPTPVCIGHRDAPSFSSPPRQAPEPSLFFQDPPGTSMESLAPSTDSLHGSPVLIPQVCIGHRDAPRASSPPRHPPSDLAFLAPSPSPGSSGGSRGSAPPGETRHNLEREEYTVLADLPPPRRLAQRQPGPQAQCSSGGRTHSPGRAEVERLFGQERRKSEAAGAFQAQDEGRSQQPSQGQSQLLRRQSSPAPSRQVTMLPAKQAELTRRSQAEPPHPWSPEKRPEGDRQLQGSPLPPRTSARTPERELRTQRPLESGQAGPRQPLGVWQSQEEPPGSQGPHRHLERSWSSQEGGLGPGGWWGCGEPSLGAAKAPEGAWGGTSREYKESWGQPEAWEEKPTHELPRELGKRSPLTSPPENWGGPAESSQSWHSGTPTAVGWGAEGACPYPRGSERRPELDWRDLLGLLRAPGEGVWARVPSLDWEGLLELLQARLPRKDPAGHRDDLARALGPELGPPGTNDVPEQESHSQPEGWAEATPVNGHSPALQSQSPVQLPSPACTSTQWPKIKVTRGPATATLAGLEQTGPLGSRSTAKGPSLPELQFQPEEPEESEPSRGQDPLTDQKQADSADKRPAEGKAGSPLKGRLVTSWRMPGDRPTLFNPFLLSLGVLRWRRPDLLNFKKGWMSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEKEVQALRAQLEAWRLQGEAPQSALRSQEDGHIPPGYISQEACERSLAEMESSHQQVMEELQRHHERELQRLQQEKEWLLAEETAATASAIEAMKKAYQEELSRELSKTRSLQQGPDGLRKQHQSDVEALKRELQVLSEQYSQKCLEIGALMRQAEEREHTLRRCQQEGQELLRHNQELHGRLSEEIDQLRGFIASQGMGNGCGRSNERSSCELEVLLRVKENELQYLKKEVQCLRDELQMMQKDKRFTSGKYQDVYVELSHIKTRSEREIEQLKEHLRLAMAALQEKESMRNSLAE

SEQ ID NO: 67970 - protein, 431 aa, Homo sapiens
MGGWKGPGQRRGKEGPEARRRAAERGGGGGGGGVPAPRSPAREPRPRSCLLLPPPWGAAMTPDLLNFKKGWMSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEKEVQALRAQLEAWRLQGEAPQSALRSQEDGHIPPGYISQLVGVITVPVLQTRPLSSERLCDLPKVTPPAGLKGGI

SEQ ID NO: 67971 - protein, 1689 aa, Homo sapiens
MEEVPGDALCEHFEANILTQNRCQNCFHPEEAHGARYQELRSPSGAEVPYCDLPRCPPAPEDPLSASTSGCQSVVDPGLRPGPKRGPSPSAGLPEEGPTAAPRSRSRELEAVPYLEGLTTSLCGSCNEDPGSDPTSSPDSATPDDTSNSSSVDWDTVERQEEEAPSWDELAVMIPRRPREGPRADSSQRAPSLLTRSPVGGDAAGQKKEDTGGGGRSAGQHWARLRGESGLSLERHRSTLTQASSMTPHSGPRSTTSQASPAQRDTAQAASTREIPRASSPHRITQRDTSRASSTQQEISRASSTQQETSRASSTQEDTPRASSTQEDTPRASSTQWNTPRASSPSRSTQLDNPRTSSTQQDNPQTSFPTCTPQRENPRTPCVQQDDPRASSPNRTTQRENSRTSCAQRDNPKASRTSSPNRATRDNPRTSCAQRDNPRASSPSRATRDNPTTSCAQRDNPRASRTSSPNRATRDNPRTSCAQRDNPRASSPSRATRDNPTTSCAQRDNPRASRTSSPNRATRDNPRTSCAQRDNPRASSPNRAARDNPTTSCAQRDNPRASRTSSPNRATRDNPRTSCAQRDNPRASSPNRATRDNPTTSCAQRDNPRASRTSSPNRATRDNPRTSCAQRDNPRASSPNRTTQQDSPRTSCARRDDPRASSPNRTIQQENPRTSCALRDNPRASSPSRTIQQENPRTSCAQRDDPRASSPNRTTQQENPRTSCARRDNPRASSRNRTIQRDNPRTSCAQRDNPRASSPNRTIQQENLRTSCTRQDNPRTSSPNRATRDNPRTSCAQRDNLRASSPIRATQQDNPRTCIQQNIPRSSSTQQDNPKTSCTKRDNLRPTCTQRDRTQSFSFQRDNPGTSSSQCCTQKENLRPSSPHRSTQWNNPRNSSPHRTNKDIPWASFPLRPTQSDGPRTSSPSRSKQSEVPWASIALRPTQGDRPQTSSPSRPAQHDPPQSSFGPTQYNLPSRATSSSHNPGHQSTSRTSSPVYPAAYGAPLTSPEPSQPPCAVCIGHRDAPRASSPPRYLQHDPFPFFPEPRAPESEPPHHEPPYIPPAVCIGHRDAPRASSPPRHTQFDPFPFLPDTSDAEHQCQSPQHEPLQLPAPVCIGYRDAPRASSPPRQAPEPSLLFQDLPRASTESLVPSMDSLHECPHIPTPVCIGHRDAPSFSSPPRQAPEPSLFFQDPPGTSMESLAPSTDSLHGSPVLIPQVCIGHRDAPRASSPPRHPPSDLAFLAPSPSPGSSGGSRGSAPPGETRHNLEREEYTVLADLPPPRRLAQRQPGPQAQCSSGGRTHSPGRAEVERLFGQERRTMLPAKQAELTRRSQAEPPHPWSPEKRPEGDRQLQGSPLPPRTSARTPERELRTQRPLESGQAGPRQPLGVWQSQEEPPGSQGPHRHLERSWSSQEGGLGPGGWWGCGEPSLGAAKAPEGAWGGTSREYKESWGQPEAWEEKPTHELPRELGKRSPLTSPPENWGGPAESSQSWHSGTPTAVGWGAEGACPYPRGSERRPELDWRDLLGLLRAPGEGVWARVPSLDWEGLLELLQARLPRKDPAGHRDDLARALGPELGPPGTNDVPEQESHSQPEGWAEATPVNGHSPALQSQSPVQLPSPACTSTQWPKIKVTRGPATATLAGLEQTGPLGSRSTAKGPSLPELQFQPEEPEESEPSRGQDPLTDQKQADS

SEQ ID NO: 67972 - protein, 256 aa, Homo sapiens
MSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRE

SEQ ID NO: 67973 - protein, 83 aa, Homo sapiens
MSILDEPGEPPSPSLTTTSTSQWKKHWFVLTDSSLKYYRDSTAEEADELDGEIDLRSCTDVTEYAVQRNYGFQIHTKDAVYTL

SEQ ID NO: 67974 - protein, 286 aa, Homo sapiens
MAEDGEEAEFHFAALYISGQWPRLRADTDLQRLGSSAMAPSRKFFVGGNWKMNGRKQSLGELIGTLNAAKVPADTEVVCAPPTAYIDFARQKLDPKIAVAAQNCYKVTNGAFTGEISPGMIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSDAVAQSTRIIYGGSVTGATCKELASQPDVDGFLVGGASLKPEFVDIINAKQ

SEQ ID NO: 67975 - protein, 249 aa, Homo sapiens
MAPSRKFFVGGNWKMNGRKQSLGELIGTLNAAKVPADTEVVCAPPTAYIDFARQKLDPKIAVAAQNCYKVTNGAFTGEISPGMIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSDAVAQSTRIIYGGSVTGATCKELASQPDVDGFLVGGASLKPEFVDIINAKQ

SEQ ID NO: 67976 - protein, 167 aa, Homo sapiens
MIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSDAVAQSTRIIYGGSVTGATCKELASQPDVDGFLVGGASLKPEFVDIINAKQ

SEQ ID NO: 67977 - protein, 410 aa, Homo sapiens
MDVMELLEEDLTCPICCSLFDDPRVLPCSHNFCKKCLEGILEGSVRNSLWRPAPFKCPTCRKETSATGINSLQVNYSLKGIVEKYNKIKISPKMPVCKGHLGQPLNIFCLTDMQLICGICATRGEHTKHVFCSIEDAYAQERDAFESLFQSFETWRRGDALSRLDTLETSKRKSLQLLTKDSDKVKEFFEKLQHTLDQKKNEILSDFETMKLAVMQAYDPEINKLNTILQEQRMAFNIAEAFKDVSEPIVFLQQMQEFREKIKVIKETPLPPSNLPASPLMKNFDTSQWEDIKLVDVDKLSLPQDTGTFISKIPWSFYKLFLLILLLGLVIVFGPTMFLEWSLFDDLATWKGCLSNFSSYLTKTADFIEQSVFYWEQVTDGFFIFNERFKNFTLVVLNNVAEFVCKYKLL

SEQ ID NO: 67978 - protein, 410 aa, Homo sapiens; identical to SEQ ID NO: 67977

SEQ ID NO: 67979 - protein, 407 aa, Homo sapiens
MELLEEDLTCPICCSLFDDPRVLPCSHNFCKKCLEGILEGSVRNSLWRPAPFKCPTCRKETSATGINSLQVNYSLKGIVEKYNKIKISPKMPVCKGHLGQPLNIFCLTDMQLICGICATRGEHTKHVFCSIEDAYAQERDAFESLFQSFETWRRGDALSRLDTLETSKRKSLQLLTKDSDKVKEFFEKLQHTLDQKKNEILSDFETMKLAVMQAYDPEINKLNTILQEQRMAFNIAEAFKDVSEPIVFLQQMQEFREKIKVIKETPLPPSNLPASPLMKNFDTSQWEDIKLVDVDKLSLPQDTGTFISKIPWSFYKLFLLILLLGLVIVFGPTMFLEWSLFDDLATWKGCLSNFSSYLTKTADFIEQSVFYWEQVTDGFFIFNERFKNFTLVVLNNVAEFVCKYKLL

SEQ ID NO: 67980 - protein, 266 aa, Homo sapiens
MELLEEDLTCPICCSLFDDPRVLPCSHNFCKKCLEGILEGSVRNSLWRPAPFKCPTCRKETSATGINSLQVNYSLKGIVEKYNKIKISPKMPVCKGHLGQPLNIFCLTDMQLICGICATRGEHTKHVFCSIEDAYAQERDAFESLFQSFETWRRGDALSRLDTLETSKRKSLQLLTKDSDKVKEFFEKLQHTLDQKKNEILSDFETMKLAVMQAYDPEINKLNTILQEQRMAFNIAEAFKDVSEPIVFLQQMQEFREKIKVIKETP

SEQ ID NO: 67981 - protein, 407 aa, Homo sapiens; identical to SEQ ID NO: 67979

SEQ ID NO: 67982 - protein, 129 aa, Homo sapiens
MELLEEDLTCPICCSLFDDPRVLPCSHNFCKKCLEGILEGSVRNSLWRPAPFKCPTCRKETSATGINSLQVNYSLKGIVEKYNKIKISPKMPVCKGHLGQPLNIFCLTDMQLICGICATRGEHTKHVFC

SEQ ID NO: 67983 - protein, 407 aa, Homo sapiens; identical to SEQ ID NO: 67979

SEQ ID NO: 67984 - protein, 222 aa, Homo sapiens
MNDLSNRVWSISQEPDPVQRLQAYTATEQEMQQQMSLGELCHPVPLSFEPVKSFFKGLVEAVESTLQTPLDIRLKESINCQLSDPSSTKPGTLLKTSPSPERSLLLKSCWAAWGPCPCCGSTRSGKCWLVTASPPAATTGRLTCRRRAPAGGWARPTPPFGAAGPRPPPAWAATASPGASSATTLSTGPSTTASAAACGPATTSTGSASSWTTRPASSPSTT

SEQ ID NO: 67985 - protein, 442 aa, Homo sapiens
MAGAATGSRTPGRSELVEGCGWRCPEHGDRVAELFCRRCRRCVCALCPVLGAHRGHPVGLALEAAVHVQKLSQECLKQLAIKKQQHIDNITQIEDATEKLKANAESSKTWLKGKFTELRLLLDEEEALAKKFIDKNTQLTLQVYREQADSCREQLDIMNDLSNRVWSISQEPDPVQRLQAYTATEQEMQQQMSLGELCHPVPLSFEPVKSFFKGLVEAVESTLQTPLDIRLKESINCQLSDPSSTKPGTLLKTSPSPERSLLLKYARTPTLDPDTMHARLRLSADRLTVRCGLLGSLGPVPVLRFDALWQVLARDCFATGRHYWEVDVQEAGAGWWVGAAYASLRRRGASAAARLGCNRQSWCLKRYDLEYWAFHDGQRSRLRPRDDLDRLGVFLDYEAGVLAFYDVTGGMSHLHTFRATFQEPLYPALRLWEGAISIPRLP

SEQ ID NO: 67986 - protein, 442 aa, Homo sapiens; identical to SEQ ID NO: 67985

SEQ ID NO: 67987 - protein, 406 aa, Homo sapiens
MAGAATGSRTPGRSELVEGCGWRCPEHGDRVAELFCRRCRRCVCALCPVLGAHRGHPVGLALEAAVHVQKLSQECLKQLAIKKQQHIDNITQIEDATEKLKANAESSKTWLKGKFTELRLLLDEEEALAKKFIDKNTQLTLQVYREQADSCREQLDIMNDLSNRVWSISQEPDPVQRLQAYTATEQEMQQQMSLGELCHPVPLSFEPVKSFFKGLVEAVESTLQTPLDIRLKESINCQLSDPSSTKPGTLLKTSPSPERSLLLKYARTPTLDPDTMHARLRLSADRLTVRCGLLGSLGPVPVLRFDALWQVLARDCFATGRHYWEVDVQEAGAGWWVGAAYASLRRRGASAAARLGCNRQSWCLKRYDLEYWAFHDGQRSACGPATTSTGSASSWTTRPASSPSTT

SEQ ID NO: 67988 - protein, 253 aa, Homo sapiens
MAGAATGSRTPGRSELVEGCGWRCPEHGDRVAELFCRRCRRCVCALCPVLGAHRGHPVGLALEAAVHVQKLSQECLKQLAIKKQQHIDNITQIEDATEKLKANAESSKTWLKGKFTELRLLLDEEEALAKKFIDKNTQLTLQVYREQADSCREQLDIMNDLSNRVWSISQEPDPVQRLQAYTATEQEMQQQMSLGELCHPVPLSFEPVKSFFKGLVEAVESTLQTPLDIRLSPTNHAYSALKVSSPRLVSNRP

SEQ ID NO: 67989 - protein, 442 aa, Homo sapiens; identical to SEQ ID NO: 67985

SEQ ID NO: 67990 - protein, 223 aa, Homo sapiens
MSAGSDGGGRHFCGGINCQLSDPSSTKPGTLLKTSPSPERSLLLKYARTPTLDPDTMHARLRLSADRLTVRCGLLGSLGPVPVLRFDALWQVLARDCFATGRHYWEVDVQEAGAGWWVGAAYASLRRRGASAAARLGCNRQSWCLKRYDLEYWAFHDGQRSRLRPRDDLDRLGVFLDYEAGVLAFYDVTGGMSHLHTFRATFQEPLYPALRLWEGAISIPRLP

SEQ ID NO: 67991 - protein, 771 aa, Homo sapiens
MHRSGRYGTQQQRAGSKTAGPPCQWSRMASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSNFTAQALNHGTETEVLLVKKQMSEKLNELADQDFPLHPRENDQLDFIVETEGLKKSIHNLGTILTTNAVASETVATGEGLRQTIIGQPMSVTITTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVGTKGRNKGEFTNLQGVAASTNGKILIADSNNQCVQIFSNDGQFKSRFGIRGRSPGQLQRPTGVAVHPSGDIIIADYDNKWVSIFSSDGKFKTKIGSGKLMGPKGVSVDRNGHIIVVDNKACCVFIFQPNGKIVTRFGSRGNGDRQFAGPHFAAVNSNNEIIITDFHNHSVKVFNQEGEFMLKFGSNGEGNGQFNAPTGVAVDSNGNIIVADWGNSRIQVFDGSGSFLSYINTSADPLYGPQGLALTSDGHVVVADSGNHCFKVYRYLQ

SEQ ID NO: 67992 - protein, 744 aa, Homo sapiens
MASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSNFTAQALNHGTETEVLLVKKQMSEKLNELADQDFPLHPRENDQLDFIVETEGLKKSIHNLGTILTTNAVASETVATGEGLRQTIIGQPMSVTITTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVGTKGRNKGEFTNLQGVAASTNGKILIADSNNQCVQIFSNDGQFKSRFGIRGRSPGQLQRPTGVAVHPSGDIIIADYDNKWVSIFSSDGKFKTKIGSGKLMGPKGVSVDRNGHIIVVDNKACCVFIFQPNGKIVTRFGSRGNGDRQFAGPHFAAVNSNNEIIITDFHNHSVKVFNQEGEFMLKFGSNGEGNGQFNAPTGVAVDSNGNIIVADWGNSRIQVFDGSGSFLSYINTSADPLYGPQGLALTSDGHVVVADSGNHCFKVYRYLQ

SEQ ID NO: 67993 - protein, 475 aa, Homo sapiens [sequence omitted]

SEQ ID NO: 67994 - protein, 475 aa, Homo sapiens
MASAARLTMMWEEVTCPICLDPFVEPVSIECGHSFCQECISQVGKGGGSVCPVCRQRFLLKNLRPNRQLANMVNNLKEISQEAREGTQGERCAVHGERLHLFCEKDGKALCWVCAQSRKHRDHAMVPLEEAAQEYQEKLQVALGELRRKQELAEKLEVEIAIKRADWKKTVETQKSRIHAEFVQQKNFLVEEEQRQLQELEKDEREQLRILGEKEAKLAQQSQALQELISELDRRCHSSALELLQEVIVLGPRSESWNLKDLDITSPELRSVCHVPGLKKMLRTCAVHITLDPDTANPWLILSEDRRQVRLGDTQQSIPGNEERFDSYPMVLGAQHFHSGKHYWEVDVTGKEAWDLGVCRDSVRRKGHFLLSSKSGFWTIWLWNKQKYEAGTYPQTPLHLQVPPCQVGIFLDYEAGMVSFYNITDHGSLIYSFSECAFTGPLRPFFSPGFNDGGKNTAPLTLCPLNIGSQGSTDY

SEQ ID NO: 67995 - protein, 498 aa, Homo sapiens
MDFSVKVDIEKEVTCPICLELLTEPLSLDCGHSFCQACITAKIKESVIISRGESSCPVCQTRFQPGNLRPNRHLANIVERVKEVKMSPQEGQKRDVCEHHGKKLQIFCKEDGKVICWVCELSQEHQGHQTFRINEVVKECQEKLQVALQRLIKEDQEAEKLEDDIRQERTAWKNYIQIERQKILKGFNEMRVILDNEEQRELQKLEEGEVNVLDNLAAATDQLVQQRQDASTLISDLQRRLRGSSVEMLQDVIDVMKRSESWTLKKPKSVSKKLKSVFRVPDLSGMLQVLKELTDVQYYWVDVMLNPGSATSNVAISVDQRQVKTVRTCTFKNSNPCDFSAFGVFGCQYFSSGKYYWEVDVSGKIAWILGVHSKISSLNKRKSSGFAFDPSVNYSKVYSRYRPQYGYWVIGLQNTCEYNAFEDSSSSDPKVLTLFMAVPPCRIGVFLDYEAGIVSFFNVTNHGALIYKFSGCRFSRPAYPYFNPWNCLVPMTVCPPSS

SEQ ID NO: 67996 - protein, 227 aa, Homo sapiens
MDFSVKVDIEKEVTCPICLELLTEPLSLDCGHSFCQACITAKIKESVIISRGESSCPVCQTRFQPGNLRPNRHLANIVERVKEVKMSPQEGQKRDVCEHHGKKLQIFCKEDGKVICWVCELSQEHQGHQTFRINEVVKECQEKLQVALQRLIKEDQEAEKLEDDIRQERTAWKNYIQIERQKILKGFNEMRVILDNEEQRELQKLEEGEVNVLDNLAAATDQLVQQR

SEQ ID NO: 67997 - protein, 203 aa, Homo sapiens
MDFSVKVDIEKEVTCPICLELLTEPLSLDCGHSFCQACITAKIKESVIISRGESSCPVCQTRFQPGNLRPNRHLANIVERVKEVKMSPQEGQKRDVCEHHGKKLQIFCKEDGKVICWVCELSQEHQGHQTFRINEVVKECQEKLQVALQRLIKEDQEAEKLEDDIRQERTAWKNYIQIERQKILKGFNEMRVILDNEEQRELQ

SEQ ID NO: 67998 - protein, 420 aa, Homo sapiens
MDFSVKVDIEKEVTCPICLELLTEPLSLDCGHSFCQACITAKIKESVIISRGESSCPVCQTRFQPGNLRPNRHLANIVERVKEVKMSPQEGQKRDVCEHHGKKLQIFCKEDGKVILDNEEQRELQKLEEGEVNVLDNLAAATDQLVQQRQDASTLISDLQRRLRGSSVEMLQDVIDVMKRSESWTLKKPKSVSKKLKSVFRVPDLSGMLQVLKELTDVQYYWVDVMLNPGSATSNVAISVDQRQVKTVRTCTFKNSNPCDFSAFGVFGCQYFSSGKYYWEVDVSGKIAWILGVHSKISSLNKRKSSGFAFDPSVNYSKVYSRYRPQYGYWVIGLQNTCEYNAFEDSSSSDPKVLTLFMAVPPCRIGVFLDYEAGIVSFFNVTNHGALIYKFSGCRFSRPAYPYFNPWNCLVPMTVCPPSS

SEQ ID NO: 67999 - protein, 309 aa, Homo sapiens [sequence omitted]

SEQ ID NO: 68000 - protein, 630 aa, Homo sapiens
MAELCPLAEELSCSICLEPFKEPVTTPCGHNFCGSCLNETWAVQGSPYLCPQCRAVYQARPQLHKNTVLCNVVEQFLQADLAREPPADVWTPPARASAPSPNAQVACDHCLKEAAVKTCLVCMASFCQEHLQPHFDSPAFQDHPLQPPVRDLLRRKCSQHNRLREFFCPEHSECICHICLVEHKTCSPASLSQASADLEATLRHKLTVMYSQINGASRALDDVRNRQQDVRMTANRKVEQLQQEYTEMKALLDASETTSTRKIKEEEKRVNSKFDTIYQILLKKKSEIQTLKEEIEQSLTKRDEFEFLEKASKLRGISTKPVYIPEVELNHKLIKGIHQSTIDLKNELKQCIGRLQEPTPSSGDPGEHDPASTHKSTRPVKKVSKEEKKSKKPPPVPALPSKLPTFGAPEQLVDLKQAGLEAAAKATSSHPNSTSLKAKVLETFLAKSRPELLEYYIKVILDYNTAHNKVALSECYTVASVAEMPQNYRPHPQRFTYCSQVLGLHCYKKGIHYWEVELQKNNFCGVGICYGSMNRQGPESRLGRNSASWCVEWFNTKISAWHNNVEKTLPSTKATRVGVLLNCDHGFVIFFAVADKVHLMYKFRVDFTEALYPAFWVFSAGATLSICSPK

SEQ ID NO: 68001 - protein, 630 aa, Homo sapiens; identical to SEQ ID NO: 68000

SEQ ID NO: 68002 - protein, 358 aa, Homo sapiens
MASGSVAECLQQETTCPVCLQYFAEPMMLDCGHNICCACLARCWGTAETNVSCPQCRETFPQRHMRPNRHLANVTQLVKQLRTERPSGPGGEMGVCEKHREPLKLYCEEDQMPICVVCDRSREHRGHSVLPLEEAVEGFKEQIQNQLDHLKRVKDLKKRRRAQGEQARAELLSLTQMEREKIVWEFEQLYHSLKEHEYRLLARLEELDLAIYNSINGAITQFSCNISHLSSLIAQLEEKQQQPTRELLQDIGDTLSRAERIRIPEPWITPPDLQEKIHIFAQKCLFLTESLKQFTEKMQSDMEKIQELREAQLYSVDVTLDPDTAYPSLILSDNLRQVRYSYLQQDLPDNPERSPSTT

SEQ ID NO: 68003 - protein, 513 aa, Homo sapiens
MASGSVAECLQQETTCPVCLQYFAEPMMLDCGHNICCACLARCWGTAETNVSCPQCRETFPQRHMRPNRHLANVTQLVKQLRTERPSGPGGEMGVCEKHREPLKLYCEEDQMPICVVCDRSREHRGHSVLPLEEAVEGFKEQIQNQLDHLKRVKDLKKRRRAQGEQARAELLSLTQMEREKIVWEFEQLYHSLKEHEYRLLARLEELDLAIYNSINGAITQFSCNISHLSSLIAQLEEKQQQPTRELLQDIGDTLSRAERIRIPEPWITPPDLQEKIHIFAQKCLFLTESLKQFTEKMQSDMEKIQELREAQLYSVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 68004 - protein, 513 aa, Homo sapiens; identical to SEQ ID NO: 68003

SEQ ID NO: 68005 - protein, 358 aa, Homo sapiens; identical to SEQ ID NO: 68002

SEQ ID NO: 68006 - protein, 248 aa, Homo sapiens
  MOD_RES (1)..(1): Any amino acid
XLKQFTEKMQSDMEKIQESADSLEGGILDLGSVLSHILPVSELREAQLYSVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 68007 - protein, 358 aa, Homo sapiens; identical to SEQ ID NO: 68002

SEQ ID NO: 68008 - protein, 248 aa, Homo sapiens; identical to SEQ ID NO: 68006
  MOD_RES (1)..(1): Any amino acid

SEQ ID NO: 68009 - protein, 358 aa, Homo sapiens; identical to SEQ ID NO: 68002

SEQ ID NO: 68010 - protein, 248 aa, Homo sapiens; identical to SEQ ID NO: 68006
  MOD_RES (1)..(1): Any amino acid

SEQ ID NO: 68011 - protein, 249 aa, Homo sapiens
MASGSVAECLQQETTCPVCLQYFAEPMMLDCGHNICCACLARCWGTAETNVSCPQCRETFPQRHMRPNRHLANVTQLVKQLRTERPSGPGGEMGVCEKHREPLKLYCEEDQMPICVVCDRSREHRGHSVLPLEEAVEGFKEQIQNQLDHLKRVKDLKKRRRAQGEQARAELLSLTQMEREKIVWEFEQLYHSLKEHEYRLLARLEELDLAIYNSINGAITQFSCNISHLSSLIAQLEEKQQQPTRELLQ

SEQ ID NO: 68012 - protein, 513 aa, Homo sapiens; identical to SEQ ID NO: 68003

SEQ ID NO: 68013 - protein, 513 aa, Homo sapiens; identical to SEQ ID NO: 68003

SEQ ID NO: 68014 - protein, 249 aa, Homo sapiens; identical to SEQ ID NO: 68011

SEQ ID NO: 68015 - protein, 513 aa, Homo sapiens; identical to SEQ ID NO: 68003

SEQ ID NO: 68016 - protein, 247 aa, Homo sapiens
LKQFTEKMQSDMEKIQESADSLEGGILDLGSVLSHILPVSELREAQLYSVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 68017 - protein, 249 aa, Homo sapiens; identical to SEQ ID NO: 68011

SEQ ID NO: 68018 - protein, 52 aa, Homo sapiens
  MOD_RES (1)..(1): Any amino acid
XLREAQLYSVDVTLDPDTAYPSLILSDNLRQVRYSYLQQDLPDNPERSPSTT

SEQ ID NO: 68019 - protein, 231 aa, Homo sapiens
  MOD_RES (1)..(1): Any amino acid
XSADSLEGGILDLGSVLSHILPVSELREAQLYSVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 68020 - protein, 207 aa, Homo sapiens
  MOD_RES (1)..(1): Any amino acid
XLREAQLYSVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 68021 - protein, 358 aa, Homo sapiens; identical to SEQ ID NO: 68002

SEQ ID NO: 68022 - protein, 248 aa, Homo sapiens; identical to SEQ ID NO: 68006
  MOD_RES (1)..(1): Any amino acid

SEQ ID NO: 68023 - protein, 249 aa, Homo sapiens; identical to SEQ ID NO: 68011

SEQ ID NO: 68024 - protein, 733 aa, Homo sapiens
MAKREDSPGPEVQPMDKQFLVCSICLDRYQCPKVLPCLHTFCERCLQNYIPAQSLTLSCPVCRQTSILPEQGVSALQNNFFISSLMEAMQQAPDGAHDPEDPHPLSVVAGRPLSCPNHEGKTMEFYCEACETAMCGECRAGEHREQHKAALQRQLEAVRGRLPQLSAAIALVGGISQQLQERKAEALAQISAAFEDLEQALQQRKQALVSDLETICGAKQKVLQSQLDTLRQGQEHIGSSCSFAEQALRLGSAPEVLLVRKHMRERLAALAAQAFPERPHENAQLELVLEVDGLRRSVLNLGALLTTSATAHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGREKGEFTNLQGVSAASSGRIVVADSNNQCIQVFSNEGQFKFRFGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGPHFVAVNNKNEIVVTDFHNHSVKVYSADGEFLFKFGSHGEGNGQFNAPTGVAVDSNGNIIVADWGNSRIQVFDSSGSFLSYINTSAEPLYGPQGLALTSDGHVVVADAGNHCFKAYRYLQ

SEQ ID NO: 68025 - protein, 744 aa, Homo sapiens
MAKREDSPGPEVQPMDKQFLVCSICLDRYQCPKVLPCLHTFCERCLQNYIPAQSLTLSCPVCRQTSILPEQGVSALQNNFFISSLMEAMQQAPDGAHDPEDPHPLSVVAGRPLSCPNHEGKTMEFYCEACETAMCGECRAGEHREHGTVLLRDVVEQHKAALQRQLEAVRGRLPQLSAAIALVGGISQQLQERKAEALAQISAAFEDLEQALQQRKQALVSDLETICGAKQKVLQSQLDTLRQGQEHIGSSCSFAEQALRLGSAPEVLLVRKHMRERLAALAAQAFPERPHENAQLELVLEVDGLRRSVLNLGALLTTSATAHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGREKGEFTNLQGVSAASSGRIVVADSNNQCIQVFSNEGQFKFRFGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGPHFVAVNNKNEIVVTDFHNHSVKVYSADGEFLFKFGSHGEGNGQFNAPTGVAVDSNGNIIVADWGNSRIQVFDSSGSFLSYINTSAEPLYGPQGLALTSDGHVVVADAGNHCFKAYRYLQ

SEQ ID NO: 68026 - protein, 744 aa, Homo sapiens; identical to SEQ ID NO: 68025

SEQ ID NO: 68027 - protein, 744 aa, Homo sapiens; identical to SEQ ID NO: 68025

SEQ ID NO: 68028 - protein, 742 aa, Homo sapiens
MAKREDSPGPEVQPMDKQFLVCSICLDRYQCPKVLPCLHTFCERCLQNYIPAQSLTLSCPVCRQTSILPEQGVSALQNNFFISSLMEAMQQAPDGAHDPEDPHPLSVVAGRPLSCPNHEGKTMEFYCEACETAMCGECRAGEHREHGTVLLRDVVEQHKAALQRQLEAVRGRLPQLSAAIALVGGISQQLQERKAEALAQISAAFEDLEQALQQRKQALVSDLETICGAKQKVLQSQLDTLRQGQEHIGSSCSFAEQALRLGSAPEVLLVRKHMRERLAALAAQAFPERPHENAQLELVLEVDGLRRSVLNLGALLTTSATAHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGREKGEFTNLQGVSAASSGRIVVADSNNQCIQVFSNEGQFKFRFGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGPHFVAVNNKNEIVVTDFHNHSVKVYSADGEFLFKFGSHGEGNGQFNAPTGVAVDSNGNIIDVCRASPYPSYTPPHPCQSAPHPPAWGQNSLPQDRSPSSCLPTTLYTLTETAIPHPPY

SEQ ID NO: 68029 - protein, 625 aa, Homo sapiens
MKTMEFYCEACETAMCGECRAGEHREHGTVLLRDVVEQHKAALQRQLEAVRGRLPQLSAAIALVGGISQQLQERKAEALAQISAAFEDLEQALQQRKQALVSDLETICGAKQKVLQSQLDTLRQGQEHIGSSCSFAEQALRLGSAPEVLLVRKHMRERLAALAAQAFPERPHENAQLELVLEVDGLRRSVLNLGALLTTSATAHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGREKGEFTNLQGVSAASSGRIVVADSNNQCIQVFSNEGQFKFRFGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGPHFVAVNNKNEIVVTDFHNHSVKVYSADGEFLFKFGSHGEGNGQFNAPTGVAVDSNGNIIVADWGNSRIQVFDSSGSFLSYINTSAEPLYGPQGLALTSDGHVVVADAGNHCFKAYRYLQ

SEQ ID NO: 68030 - protein, 666 aa, Homo sapiens
MAKREDSPGPEVQPMDKQFLVCSICLDRYQCPKVLPCLHTFCERCLQNYIPAQSLTLSCPVCRQTSILPEQGVSALQNNFFISSLMEAMQQAPDGAHDPEDPHPLSVVAGRPLSCPNHEGKTMEFYCEACETAMCGECRAGEHREHGTVLLRDVVEQHKAALQRQLEAVRGRLPQLSAAIALVGGISQQLQERKAEALAQISAAFEDLEQALQQRKQALVSDLVDGLRRSVLNLGALLTTSATAHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGREKGEFTNLQGVSAASSGRIVVADSNNQCIQVFSNEGQFKFRFGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGPHFVAVNNKNEIVVTDFHNHSVKVYSADGEFLFKFGSHGEGNGQFNAPTGVAVDSNGNIIVADWGNSRIQVFDSSGSFLSYINTSAEPLYGPQGLALTSDGHVVVADAGNHCFKAYRYLQ

SEQ ID NO: 68031 - protein, 741 aa, Homo sapiens
MAKREDSPGPEVQPMDKQFLVCSICLDRYQCPKVLPCLHTFCERCLQNYIPAQSLTLSCPVCRQTSILPEQGVSALQNNFFISSLMEAMQQAPDGAHDPEDPHPLSVVAGRPLSCPNHEGKTMEFYCEACETAMCGECRAGEHREHGTVLLRDVVEQHKAALQRQLEAVRGRLPQLSAAIALVGGISQQLQERKAEALAQISAAFEDLEQALQQRKQALVSDLETICGAKQKVLQSQLDTLRQGQEHIGSSCSFAEQALRLGSAPEVLLVRKHMRERLAALAAQAFPERPHENAQLELVLEVDGLRRSVLNLGALLTTSATAHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGREKGEFTNLQGVSAASSGRIVVADSNNQCIQVFSNEGQFKFRFGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGPHFVAVNNKNEIVVTDFHNHSVKVYSADGEFLFKFGSHGEGNGQFNAPTGVAVDSNGNIIVCRASPYPSYTPPHPCQSAPHPPAWGQNSLPQDRSPSSCLPTTLYTLTETAIPHPPY

SEQ ID NO: 68032 - protein, 425 aa, Homo sapiens [sequence omitted]

SEQ ID NO: 68033 - protein, 425 aa, Homo sapiens
MASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLVDSLKTKQNMPPRQLLEPAQPHLPRSEEFQFLNPTPVPLELEKKLSEAKSRHDSITGSLKKFKDQLQADRKKDENRFFKSMNKNDMKSWGLLQKNNHKMNKTSEPGSSSAGGRTTSGPPNHHSSAPSHSLFRASSAGKVTFPVCLLASYDEISGQGASSQDTKTFDVALSEELHAALSEWLTAIRAWFCEVPSS

SEQ ID NO: 68034 - protein, 425 aa, Homo sapiens
MASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLVDSLKTKQNMPPRQLLEDIKVVLCRSEEFQFLNPTPVPLELEKKLSEAKSRHDSITGSLKKFKDQLQADRKKDENRFFKSMNKNDMKSWGLLQKNNHKMNKTSEPGSSSAGGRTTSGPPNHHSSAPSHSLFRASSAGKVTFPVCLLASYDEISGQGASSQDTKTFDVALSEELHAALSEWLTAIRAWFCEVPSS

SEQ ID NO: 68035 - protein, 248 aa, Homo sapiens
MASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLVDSLKTKQNMPPRQLLE

SEQ ID NO: 68036 - protein, 425 aa, Homo sapiens [sequence omitted]

SEQ ID NO: 68037 - protein, 425 aa, Homo sapiens; identical to SEQ ID NO: 68034

SEQ ID NO: 68038 - protein, 425 aa, Homo sapiens; identical to SEQ ID NO: 68034

SEQ ID NO: 68039 - protein, 425 aa, Homo sapiens; identical to SEQ ID NO: 68034

SEQ ID NO: 68040 - protein, 425 aa, Homo sapiens
MASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLIDSLKTKQNMPPRQLLEDIKVVLCRSEEFQFLNPTPVPLELEKKLSEAKSRHDSITGSLKKFKDQLQADRKKDENRFFKSMNKNDMKSWGLLQKNNHKMNKTSEPGSSSAGGRTTSGPPNHHSSAPSHSLFRASSAGKVTFPVCLLASYDEISGQGASSQDTKTFDVALSEELHAALSEWLTAIRAWFCKVPSS

SEQ ID NO: 68041 - protein, 425 aa, Homo sapiens; identical to SEQ ID NO: 68034

SEQ ID NO: 68042 - protein, 425 aa, Homo sapiens; identical to SEQ ID NO: 68033

SEQ ID NO: 68043 - protein, 425 aa, Homo sapiens [sequence omitted]

SEQ ID NO: 68044 - protein, 425 aa, Homo sapiens; identical to SEQ ID NO: 68033

SEQ ID NO: 68045 - protein, 425 aa, Homo sapiens
MASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLIDSLKTKQNMPPRQLLEPAQPHLPRSEEFQFLNPTPVPLELEKKLSEAKSRHDSITGSLKKFKDQLQADRKKDENRFFKSMNKNDMKSWGLLQKNNHKMNKTSEPGSSSAGGRTTSGPPNHHSSAPSHSLFRASSAGKVTFPVCLLASYDEISGQGASSQDTKTFDVALSEELHAALSEWLTAIRAWFCKVPSS

SEQ ID NO: 68046 - protein, 425 aa, Homo sapiens
MASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCCESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLVDSLKTKQNMPPRQLLEPAQPHLPRSEEFQFLNPTPVPLELEKKLSEAKSRHDSITGSLKKFKDQLQADRKKDENRFFKSMNKNDMKSWGLLQKNNHKMNKTSEPGSSSAGGRTTSGPPNHHSSAPSHSLFRASSAGKVTFPVCLLASYDEISGQGASSQDTKTFDVALSEELHAALSEWLTAIRAWFCEVPSS

SEQ ID NO: 68047 - protein, 425 aa, Homo sapiens; identical to SEQ ID NO: 68034

SEQ ID NO: 68048 - protein, 425 aa, Homo sapiens; identical to SEQ ID NO: 68033

SEQ ID NO: 68049 - protein, 425 aa, Homo sapiens [sequence omitted]

SEQ ID NO: 68050 - protein, 425 aa, Homo sapiens; identical to SEQ ID NO: 68040

SEQ ID NO: 68051 - protein, 425 aa, Homo sapiens
MASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLVDSLKTKQNMPPRQLLEPAQPHLPRSEEFQFLNPTPVPLELEKKLSEAKSRHDSITGSLKKFKDQLQADRKKDENRFFKSMNKNDMKSWGLLQKNNHKMNKTSEPGSSSAGGRTTSGPPNHHSSAPSHSLFRASSAGKVTFPVCLLASYDEISGQGASSQDTKTFDVALSEELHAALSEWLTAIRAWFCKVPSS

SEQ ID NO: 68052 - protein, 425 aa, Homo sapiens; identical to SEQ ID NO: 68034

SEQ ID NO: 68053 - protein, 425 aa, Homo sapiens; identical to SEQ ID NO: 68034

SEQ ID NO: 68054 - protein, 653 aa, Homo sapiens
MAAAAASHLNLDALREVLECPICMESFTEEQLRPKLLHCGHTICRQCLEKLLASSINGVRCPFCSKITRITSLTQLTDNLTVLKIIDTAGLSEAVGLLMCRSCGRRLPRQFCRSCGLVLCEPCREADHQPPGHCTLPVKEAAEERRRDFGEKLTRLRELMGELQRRKAALEGVSKDLQARYKAVLQEYGHEERRVQDELARSRKFFTGSLAEVEKSNSQVVEEQSYLLNIAEVQAVSRCDYFLAKIKQADVALLEETADEEEPELTASLPRELTLQDVELLKVGHVGPLQIGQAVKKPRTVNVEDSWAMEATASAASTSVTFREMDMSPEEVVASPRASPAKQRGPEAASNIQQCLFLKKMGAKGSTPGMFNLPVSLYVTSQGEVLVADRGNYRIQVFTRKGFLKEIRRSPSGIDSFVLSFLGADLPNLTPLSVAMNCQGLIGVTDSYDNSLKVYTLDGHCVACHRSQLSKPWGITALPSGQFVVTDVEGGKLWCFTVDRGSGVVKYSCLCSAVRPKFVTCDAEGTVYFTQGLGLNLENRQNEHHLEGGFSIGSVGPDGQLGRQISHFFSENEDFRCIAGMCVDARGDLIVADSSRKEILHFPKGGGYSVLIREGLTCPVGIALTPKGQLLVLDCWDHCIKIYSYHLRRYSTP

SEQ ID NO: 68055 - protein, 173 aa, Homo sapiens
MAAAAASHLNLDALREVLECPICMESFTEEQLRPKLLHCGHTICRQCLEKLLASSINGVRCPFCSKITRITSLTQLTDNLTVLKIIDTAGLSEAVGLLMCRSCGRRLPRQFCRSCGLVLCEPCREADHQPPGHCTLPVKEAAEERRRDFGEKLTRLRELMGELQRRKAALEGV

SEQ ID NO: 68056 - protein, 653 aa, Homo sapiens; identical to SEQ ID NO: 68054

SEQ ID NO: 68057 - protein, 1127 aa, Homo sapiens
MAENKGGGEAESGGGGSGSAPVTAGAAGPAAQEAEPPLTAVLVEEEEEEGGRAGAEGGAAGPDDGGVAAASSGSAQAASSPAASVGTGVAGGAVSTPAPAPASAPAPGPSAGPPPGPPASLLDTCAVCQQSLQSRREAEPKLLPCLHSFCLRCLPEPERQLSVPIPGGSNGDIQQVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKIEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEMMKVVQVYADTQEINLKADSEVAQAGKAVALYFEDKLTEIYSDRTFAPLPEFEQEEDDGEVTEDSDEDFIQPRRKRLKSDERPVHIK

SEQ ID NO: 68058 - protein, 1110 aa, Homo sapiens
MAENKGGGEAESGGGGSGSAPVTAGAAGPAAQEAEPPLTAVLVEEEEEEGGRAGAEGGAAGPDDGGVAAASSGSAQAASSPAASVGTGVAGGAVSTPAPAPASAPAPGPSAGPPPGPPASLLDTCAVCQQSLQSRREAEPKLLPCLHSFCLRCLPEPERQLSVPIPGGSNGDIQQVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKIEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEADSEVAQAGKAVALYFEDKLTEIYSDRTFAPLPEFEQEEDDGEVTEDSDEDFIQPRRKRLKSDERPVHIK

SEQ ID NO: 68059 - protein, 888 aa, Homo sapiens
  MOD_RES (1)..(1): Any amino acid
XSVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQANVVPMMHSWYEFGAREKTQDQNVLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKIEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEMMKVVQVYADTQEINLKADSEVAQAGKAVALYFEDKLTEIYSDRTFAPLPEFEQEEDDGEVTEDSDEDFIQPRRKRLKSDERPVHIK

SEQ ID NO: 68060 - protein, 759 aa, Homo sapiens
MKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQANVVPMMHSWYEFGAREKTQDQNVLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKIEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEMMKVVQVYADTQEINLKADSEVAQAGKAVALYFEDKLTEIYSDRTFAPLPEFEQEEDDGEVTEDSDEDFIQPRRKRLKSDERPVHIK

SEQ ID NO: 68061 - protein, 842 aa, Homo sapiens
MCGSERILQAGNILEIRVGQAGARRVATMTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWAIQGSLTRRERRASGVRTRRSQGSSAMASKILLNVQEEVTCPICLELLTEPLSLDCGHSLCRACITVSNKEAVTSMGGKSSCPVCGISYSFEHLQANQHLANIVERLKEVKLSPDNGKKRDLCDHHGEKLLLFCKEDRKVICWLCERSQEHRGHHTVLTEEVFKECQEKLQAVLKRLKKEEEEAEKLEADIREEKTSWKYQVQTERQRIQTEFDQLRSILNNEEQRELQRLEEEEKKTLDKFAEAEDELVQQKQLVRELISDVECRSQWSTMELLQDMSGIMKWSEIWRLKKPKMVSKKLKTVFHAPDLSRMLQMFRELTAVRCYWVDVTLNSVNLNLNLVLSEDQRQVISVPIWPFQCYNYGVLGSQYFSSGKHYWEVDVSKKTAWILGVYCRTYSRHMKYVVRRCANRQNLYTKYRPLFGYWVIGLQNKCKYGVFEESLSSDPEVLTLSMAVPPCRVGVFLDYEAGIVSFFNVTSHGSLIYKFSKCCFSQPVYPYFNPWNCPAPMTLCPPSS

SEQ ID NO: 68062 - protein, 488 aa, Homo sapiens
MASKILLNVQEEVTCPICLELLTEPLSLDCGHSLCRACITVSNKEAVTSMGGKSSCPVCGISYSFEHLQANQHLANIVERLKEVKLSPDNGKKRDLCDHHGEKLLLFCKEDRKVICWLCERSQEHRGHHTVLTEEVFKECQEKLQAVLKRLKKEEEEAEKLEADIREEKTSWKYQVQTERQRIQTEFDQLRSILNNEEQRELQRLEEEEKKTLDKFAEAEDELVQQKQLVRELISDVECRSQWSTMELLQDMSGIMKWSEIWRLKKPKMVSKKLKTVFHAPDLSRMLQMFRELTAVRCYWVDVTLNSVNLNLNLVLSEDQRQVISVPIWPFQCYNYGVLGSQYFSSGKHYWEVDVSKKTAWILGVYCRTYSRHMKYVVRRCANRQNLYTKYRPLFGYWVIGLQNKCKYGVFEESLSSDPEVLTLSMAVPPCRVGVFLDYEAGIVSFFNVTSHGSLIYKFSKCCFSQPVYPYFNPWNCPAPMTLCPPSS

SEQ ID NO: 68063 - protein, 488 aa, Homo sapiens; identical to SEQ ID NO: 68062

SEQ ID NO: 68064 - protein, 488 aa, Homo sapiens; identical to SEQ ID NO: 68062

SEQ ID NO: 68065 - protein, 728 aa, Homo sapiens
MSESGEMSEFGYIMELIAKGKVTIKNIERELICPACKELFTHPLILPCQHSICHKCVKELLLTLDDSFNDVGSDNSNQSSPRLRLPSPSMDKIDRINRPGWKRNSLTPRTTVFPCPGCEHDVDLGERGINGLFRNFTLETIVERYRQAARAATAIMCDLCKPPPQESTKSCMDCSASYCNECFKIHHPWGTIKAQHEYVGPTTNFRPKILMCPEHETERINMYCELCRRPVCHLCKLGGNHANHRVTTMSSAYKTLKEKLSKDIDYLIGKESQVKSQISELNLLMKETECNGERAKEEAITHFEKLFEVLEERKSSVLKAIDSSKKLRLDKFQTQMEEYQGLLENNGLVGYAQEVLKETDQSCFVQTAKQLHLRIQKATESLKSFRPAAQTSFEDYVVNTSKQTELLGELSFFSSGIDVPEINEEQSKVYNNALINWHHPEKDKADSYVLEYRKINRDDEMSWNEIEVCGTSKIIQDLENSSTYAFRVRAYKGSICSPCSRELILHTPPAPVFSFLFDEKCGYNNEHLLLNLKRDRVESRAGFNLLLAAERIQVGYYTSLDYIIGDTGITKGKHFWAFRVEPYSYLVKVGVASSDKLQEWLRSPRDAVSPRYEQDSGHDSGSEDACFDSSQPFTLVTIGMQKFFIPKSPTSSNEPENRVLPMPTSIGIFLDCDKGKVDFYDMDQMKCLYERQVDCSHTLYPAFALMGSGGIQLEEPITAKYLEYQEDM

SEQ ID NO: 68066 - protein, 61 aa, Homo sapiens
MSESGEMSEFGYIMELIAKGKASAMGLQQTHEHSRLTSKGGEARCPFEISEVGKQSLPRRT

SEQ ID NO: 68067 - protein, 60 aa, Homo sapiens
MSESGEMSEFGYIMELIAKGKMPDWRRGYRCRQGCGKTTELATATDFSQTGNKSGKHFKT

SEQ ID NO: 68068 - protein, 964 aa, Homo sapiens
MDEQSVESIAEVFRCFICMEKLRDARLCPHCSKLCCFSCIRRWLTEQRAQCPHCRAPLQLRELVNCRWAEEVTQQLDTLQLCSLTKHEENEKDKCENHHEKLSVFCWTCKKCICHQCALWGGMHGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQLRSCSKSELISKSSEILMMFQQVHRKPMASFVTTPVPPDFTSELVPSYDSATFVLENFSTLRQRADPVYSPPLQVSGLCWRLKVYPDGNGVVRGYYLSVFLELSAGLPETSKYEYRVEMVHQSCNDPTKNIIREFASDFEVGECWGYNRFFRLDLLANEGYLNPQNDTVILRFQVRSPTFFQKSRDQHWYITQLEAAQTSYIQQINNLKERLTIELSRTQKSRDLSPPDNHLSPQNDDALETRAKKSACSDMLLEGGPTTASVREAKEDEEDEEKIQNEDYHHELSDGDLDLDLVYEDEVNQLDGSSSSASSTATSNTEENDIDEETMSGENDVEYNNMELEEGELMEDAAAAGPAGSSHGYVGSSSRISRRTHLCSAATSSLLDIDPLILIHLLDLKDRSSIENLWGLQPRPPASLLQPTASYSRKDKDQRKQQAMWRVPSDLKMLKRLKTQMAEVRCMKTDVKNTLSEIKSSSAASGDMQTSLFSADQAALAACGTENSGRLQDLGMELLAKSSVANCYIRNSTNKKSNSPKPARSSVAGSLSLRRAVDPGENSRSKGDCQTLSEGSPGSSQSGSRHSSPRALIHGSIGDILPKTEDRQCKALDSDAVVVAVFSGLPAVEKRRKMVTLGANAKGGHLEGLQMTDLENNSETGELQPVLPEGASAAPEEGMSSDSDIECDTENEEQEEHTSVGGFHDSFMVMTQPPDEDTHSSFPDGEQIGPEDLSFNTDENSGR

SEQ ID NO: 68069 - protein, 803 aa, Homo sapiens
MHGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQLRSCSKSELISKSSEILMMFQQVHRKPMASFVTTPVPPDFTSELVPSYDSATFVLENFSTLRQRADPVYSPPLQVSGLCWRLKVYPDGNGVVRGYYLSVFLELSAGLPETSKYEYRVEMVHQSCNDPTKNIIREFASDFEVGECWGYNRFFRLDLLANEGYLNPQNDTVILRFQVRSPTFFQKSRDQHWYITQLEAAQTSYIQQINNLKERLTIELSRTQKSRDLSPPDNHLSPQNDDALETRAKKSACSDMLLEGGPTTASVREAKEDEEDEEKIQNEDYHHELSDGDLDLDLVYEDEVNQLDGSSSSASSTATSNTEENDIDEETMSGENDVEYNNMELEEGELMEDAAAAGPAGSSHGYVGSSSRISRRTHLCSAATSSLLDIDPLILIHLLDLKDRSSIENLWGLQPRPPASLLQPTASYSRKDKDQRKQQAMWRVPSDLKMLKRLKTQMAEVRCMKTDVKNTLSEIKSSSAASGDMQTSLFSADQAALAACGTENSGRLQDLGMELLAKSSVANCYIRNSTNKKSNSPKPARSSVAGSLSLRRAVDPGENSRSKGDCQTLSEGSPGSSQSGSRHSSPRALIHGSIGDILPKTEDRQCKALDSDAVVVAVFSGLPAVEKRRKMVTLGANAKGGHLEGLQMTDLENNSETGELQPVLPEGASAAPEEDTHSSFPDGEQIGPEDLSFNTDENSGR

SEQ ID NO: 68070 - protein, 930 aa, Homo sapiens
MDEQSVERWLTEQRAQCPHCRAPLQLRELVNCRWAEEVTQQLDTLQLCSLTKHEENEKDKCENHHEKLSVFCWTCKKCICHQCALWGGMHGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQLRSCSKSELISKSSEILMMFQQVHRKPMASFVTTPVPPDFTSELVPSYDSATFVLENFSTLRQRADPVYSPPLQVSGLCWRLKVYPDGNGVVRGYYLSVFLELSAGLPETSKYEYRVEMVHQSCNDPTKNIIREFASDFEVGECWGYNRFFRLDLLANEGYLNPQNDTVILRFQVRSPTFFQKSRDQHWYITQLEAAQTSYIQQINNLKERLTIELSRTQKSRDLSPPDNHLSPQNDDALETRAKKSACSDMLLEGGPTTASVREAKEDEEDEEKIQNEDYHHELSDGDLDLDLVYEDEVNQLDGSSSSASSTATSNTEENDIDEETMSGENDVEYNNMELEEGELMEDAAAAGPAGSSHGYVGSSSRISRRTHLCSAATSSLLDIDPLILIHLLDLKDRSSIENLWGLQPRPPASLLQPTASYSRKDKDQRKQQAMWRVPSDLKMLKRLKTQMAEVRCMKTDVKNTLSEIKSSSAASGDMQTSLFSADQAALAACGTENSGRLQDLGMELLAKSSVANCYIRNSTNKKSNSPKPARSSVAGSLSLRRAVDPGENSRSKGDCQTLSEGSPGSSQSGSRHSSPRALIHGSIGDILPKTEDRQCKALDSDAVVVAVFSGLPAVEKRRKMVTLGANAKGGHLEGLQMTDLENNSETGELQPVLPEGASAAPEEGMSSDSDIECDTENEEQEEHTSVGGFHDSFMVMTQPPDEDTHSSFPDGEQIGPEDLSFNTDENSGR

SEQ ID NO: 68071 - protein, 964 aa, Homo sapiens; identical to SEQ ID NO: 68068

SEQ ID NO: 68072 - protein, 518 aa, Homo sapiens
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKDVKSTLEKNIPRKFGGSLSTICPRDHKALLGLVKEINRCEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEVGDKTHWAVGVCRDSVSRKGELTPLPETGYWRVRLWNGDKYAATTTPFTPLHIKVKPKRVGIFLDYEAGTLSFYNVTDRSHIYTFTDTFTEKLWPLFYPGIRAGRKNAAPLTIRPPTDWE

SEQ ID NO: 68073 - protein, 488 aa, Homo sapiens
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKDVKSTLEKCEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEVGDKTHWAVGVCRDSVSRKGELTPLPETGYWRVRLWNGDKYAATTTPFTPLHIKVKPKRVGIFLDYEAGTLSFYNVTDRSHIYTFTDTFTEKLWPLFYPGIRAGRKNAAPLTIRPPTDWE

SEQ ID NO: 68074 - protein, 488 aa, Homo sapiens; identical to SEQ ID NO: 68073

SEQ ID NO: 68075 - protein, 518 aa, Homo sapiens; identical to SEQ ID NO: 68072

SEQ ID NO: 68076 - protein, 488 aa, Homo sapiens; identical to SEQ ID NO: 68073

SEQ ID NO: 68077 - protein, 518 aa, Homo sapiens; identical to SEQ ID NO: 68072

SEQ ID NO: 68078 - protein, 488 aa, Homo sapiens; identical to SEQ ID NO: 68073

SEQ ID NO: 68079 - protein, 488 aa, Homo sapiens; identical to SEQ ID NO: 68073

SEQ ID NO: 68080 - protein, 488 aa, Homo sapiens; identical to SEQ ID NO: 68073

SEQ ID NO: 68081 - protein, 144 aa, Homo sapiens
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLD

SEQ ID NO: 68082 - protein, 227 aa, Homo sapiens
  MOD_RES (1)..(1): Any amino acid
XTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKDVKSTLEKCEKVKTMEVTSTTPCTSLHSEINDNVRGR

SEQ ID NO: 68083 - protein, 74 aa, Homo sapiens
MAETSLLEAGASAASTAAALENLQVEASCSVCLEYLKEPVIIECGHNFCKACITRWWEDLERDFPCPVCRKTSR

SEQ ID NO: 68084 - protein, 417 aa, Homo sapiens
MVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKPVLSAREECEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTQGSSNQ

SEQ ID NO: 68085 - protein, 518 aa, Homo sapiens; identical to SEQ ID NO: 68072

SEQ ID NO: 68086 - protein, 488 aa, Homo sapiens; identical to SEQ ID NO: 68073

SEQ ID NO: 68087 - protein, 144 aa, Homo sapiens; identical to SEQ ID NO: 68081

SEQ ID NO: 68088 - protein, 74 aa, Homo sapiens; identical to SEQ ID NO: 68083

SEQ ID NO: 68089 - protein, 48 aa, Homo sapiens
MAETSLLEAGASAASTAAALENLQVEASCSVCLEYLKEPVIIECGHNF

SEQ ID NO: 68090 - protein, 488 aa, Homo sapiens; identical to SEQ ID NO: 68073

SEQ ID NO: 68091 - protein, 227 aa, Homo sapiens; identical to SEQ ID NO: 68082
  MOD_RES (1)..(1): Any amino acid

SEQ ID NO: 68092 - protein, 48 aa, Homo sapiens; identical to SEQ ID NO: 68089

SEQ ID NO: 68093 - protein, 48 aa, Homo sapiens; identical to SEQ ID NO: 68089

SEQ ID NO: 68094 - protein, 59 aa, Homo sapiens
MAETSLLEAGASAASTAAALENLQVEASCSVCLEYLKEPVIIECGHNFCKACITRWWED

SEQ ID NO: 68095 - protein, 59 aa, Homo sapiens; identical to SEQ ID NO: 68094

SEQ ID NO: 68096 - protein, 144 aa, Homo sapiens; identical to SEQ ID NO: 68081

SEQ ID NO: 68097 - protein, 518 aa, Homo sapiens; identical to SEQ ID NO: 68072

SEQ ID NO: 68098 - protein, 227 aa, Homo sapiens; identical to SEQ ID NO: 68082
  MOD_RES (1)..(1): Any amino acid

SEQ ID NO: 68099 - protein, 227 aa, Homo sapiens; identical to SEQ ID NO: 68082
  MOD_RES (1)..(1): Any amino acid

SEQ ID NO: 68100 - protein, 48 aa, Homo sapiens; identical to SEQ ID NO: 68089

SEQ ID NO: 68101 - protein, 518 aa, Homo sapiens; identical to SEQ ID NO: 68072

SEQ ID NO: 68102 - protein, 74 aa, Homo sapiens; identical to SEQ ID NO: 68083

SEQ ID NO: 68103 - protein, 59 aa, Homo sapiens; identical to SEQ ID NO: 68094

SEQ ID NO: 68104 - protein, 48 aa, Homo sapiens; identical to SEQ ID NO: 68089

SEQ ID NO: 68105 - protein, 261 aa, Homo sapiens
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKV

SEQ ID NO: 68106 - protein, 59 aa, Homo sapiens; identical to SEQ ID NO: 68094

SEQ ID NO: 68107 - protein, 144 aa, Homo sapiens; identical to SEQ ID NO: 68081

SEQ ID NO: 68108 - protein, 488 aa, Homo sapiens; identical to SEQ ID NO: 68073

SEQ ID NO: 68109 - protein, 488 aa, Homo sapiens; identical to SEQ ID NO: 68073

SEQ ID NO: 68110 - protein, 261 aa, Homo sapiens; identical to SEQ ID NO: 68105

SEQ ID NO: 68111 - protein, 488 aa, Homo sapiens; identical to SEQ ID NO: 68073

SEQ ID NO: 68112 - protein, 59 aa, Homo sapiens; identical to SEQ ID NO: 68094

SEQ ID NO: 68113 - protein, 59 aa, Homo sapiens; identical to SEQ ID NO: 68094

SEQ ID NO: 68114 - protein, 227 aa, Homo sapiens; identical to SEQ ID NO: 68082
  MOD_RES (1)..(1): Any amino acid

SEQ ID NO: 68115 - protein, 488 aa, Homo sapiens; identical to SEQ ID NO: 68073

SEQ ID NO: 68116 - protein, 74 aa, Homo sapiens; identical to SEQ ID NO: 68083

SEQ ID NO: 68117 - protein, 227 aa, Homo sapiens; identical to SEQ ID NO: 68082
  MOD_RES (1)..(1): Any amino acid

SEQ ID NO: 68118 - protein, 488 aa, Homo sapiens; identical to SEQ ID NO: 68073

SEQ ID NO: 68119 - protein, 488 aa, Homo sapiens; identical to SEQ ID NO: 68073

SEQ ID NO: 68120 - protein, 261 aa, Homo sapiens; identical to SEQ ID NO: 68105

SEQ ID NO: 68121 - protein, 74 aa, Homo sapiens; identical to SEQ ID NO: 68083

SEQ ID NO: 68122 - protein, 59 aa, Homo sapiens; identical to SEQ ID NO: 68094

SEQ ID NO: 68123 - protein, 261 aa, Homo sapiens; identical to SEQ ID NO: 68105

SEQ ID NO: 68124 - protein, 488 aa, Homo sapiens; identical to SEQ ID NO: 68073

SEQ ID NO: 68125 - protein, 518 aa, Homo sapiens; identical to SEQ ID NO: 68072

SEQ ID NO: 68126 - protein, 488 aa, Homo sapiens; identical to SEQ ID NO: 68073

SEQ ID NO: 68127 - protein, 261 aa, Homo sapiens; identical to SEQ ID NO: 68105

SEQ ID NO: 68128 - protein, 74 aa, Homo sapiens; identical to SEQ ID NO: 68083

SEQ ID NO: 68129 - protein, 411 aa, Homo sapiens
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKPVLSAREECEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEVGDKTHWAVGVCRDSVSRKGGCGYGMGTNMQPPPHLLPLCTSR

SEQ ID NO: 68130 - protein, 488 aa, Homo sapiens; identical to SEQ ID NO: 68073

SEQ ID NO: 68131 - protein, 261 aa, Homo sapiens; identical to SEQ ID NO: 68105

SEQ ID NO: 68132 - protein, 48 aa, Homo sapiens; identical to SEQ ID NO: 68089

SEQ ID NO: 68133 - protein, 261 aa, Homo sapiens; identical to SEQ ID NO: 68105

SEQ ID NO: 68134 - protein, 488 aa, Homo sapiens; identical to SEQ ID NO: 68073

SEQ ID NO: 68135 - protein, 74 aa, Homo sapiens; identical to SEQ ID NO: 68083

SEQ ID NO: 68136 - protein, 488 aa, Homo sapiens; identical to SEQ ID NO: 68073

SEQ ID NO: 68137 - protein, 518 aa, Homo sapiens; identical to SEQ ID NO: 68072

SEQ ID NO: 68138 - protein, 488 aa, Homo sapiens; identical to SEQ ID NO: 68073

SEQ ID NO: 68139 - protein, 144 aa, Homo sapiens; identical to SEQ ID NO: 68081

SEQ ID NO: 68140 - protein, 144 aa, Homo sapiens; identical to SEQ ID NO: 68081

SEQ ID NO: 68141 - protein, 227 aa, Homo sapiens; identical to SEQ ID NO: 68082
  MOD_RES (1)..(1): Any amino acid

SEQ ID NO: 68142 - protein, 48 aa, Homo sapiens; identical to SEQ ID NO: 68089

SEQ ID NO: 68143 - protein, 144 aa, Homo sapiens; identical to SEQ ID NO: 68081

SEQ ID NO: 68144 - protein, 488 aa, Homo sapiens; identical to SEQ ID NO: 68073

SEQ ID NO: 68145 - protein, 488 aa, Homo sapiens
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKPVLSAREECEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEVGDKTHWAVGVCRDSVSRKGELTPLPETGYWRVRLWNGDKYAATTTPFTPLHIKVKPKRVGIFLDYEAGTLSFYNVTDRSHIYTFTDTFTEKLWPLFYPGIRAGRKNAAPLTIRPPTDWE

SEQ ID NO: 68146 - protein, 518 aa, Homo sapiens
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKPVLSAREKNIPRKFGGSLSTICPRDHKALLGLVKEINRCEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEVGDKTHWAVGVCRDSVSRKGELTPLPETGYWRVRLWNGDKYAATTTPFTPLHIKVKPKRVGIFLDYEAGTLSFYNVTDRSHIYTFTDTFTEKLWPLFYPGIRAGRKNAAPLTIRPPTDWE

SEQ ID NO: 68147 - protein, 411 aa, Homo sapiens; identical to SEQ ID NO: 68129

SEQ ID NO: 68148 - protein, 518 aa, Homo sapiens; identical to SEQ ID NO: 68146

SEQ ID NO: 68149 - protein, 488 aa, Homo sapiens; identical to SEQ ID NO: 68145

SEQ ID NO: 68150 - protein, 518 aa, Homo sapiens; identical to SEQ ID NO: 68072

SEQ ID NO: 68151 - protein, 488 aa, Homo sapiens; identical to SEQ ID NO: 68145

SEQ ID NO: 68152 - protein, 488 aa, Homo sapiens; identical to SEQ ID NO: 68145

SEQ ID NO: 68153 - protein, 488 aa, Homo sapiens; identical to SEQ ID NO: 68145

SEQ ID NO: 68154 - protein, 518 aa, Homo sapiens; identical to SEQ ID NO: 68072

SEQ ID NO: 68155 - protein, 411 aa, Homo sapiens; identical to SEQ ID NO: 68129

SEQ ID NO: 68156 - protein, 518 aa, Homo sapiens; identical to SEQ ID NO: 68146

SEQ ID NO: 68157 - protein, 411 aa, Homo sapiens; identical to SEQ ID NO: 68129

SEQ ID NO: 68158 - protein, 411 aa, Homo sapiens; identical to SEQ ID NO: 68129

SEQ ID NO: 68159 - protein, 518 aa, Homo sapiens; identical to SEQ ID NO: 68072

SEQ ID NO: 68160 - protein, 518 aa, Homo sapiens; identical to SEQ ID NO: 68146

SEQ ID NO: 68161 - protein, 518 aa, Homo sapiens; identical to SEQ ID NO: 68146

SEQ ID NO: 68162 - protein, 518 aa, Homo sapiens; identical to SEQ ID NO: 68072

SEQ ID NO: 68163 - protein, 518 aa, Homo sapiens; identical to SEQ ID NO: 68146

SEQ ID NO: 68164 - protein, 417 aa, Homo sapiens
MVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKPVLSAREECEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEAAHCVLAQDPENQALARFYCYTERTIAKRLVLRRDPSVKRTLCRGCSSLLVPGLTCTHRQRRCRGQRWTVQTCLTCQRSQRFLNDPGHLLWGDRPEAQLGSQADSKPLQPLPNTAHSISDRLPEEKMQTQGSSNQ

SEQ ID NO: 68165 - protein, 417 aa, Homo sapiens; identical to SEQ ID NO: 68164

SEQ ID NO: 68166 - protein, 411 aa, Homo sapiens; identical to SEQ ID NO: 68129

SEQ ID NO: 68167 - protein, 417 aa, Homo sapiens; identical to SEQ ID NO: 68164

SEQ ID NO: 68168 - protein, 518 aa, Homo sapiens; identical to SEQ ID NO: 68146

SEQ ID NO: 68169 - protein, 417 aa, Homo sapiens
MVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKPVLSAREECEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTKGSSNQ

SEQ ID NO: 68170 - protein, 411 aa, Homo sapiens; identical to SEQ ID NO: 68129

SEQ ID NO: 68171 - protein, 417 aa, Homo sapiens; identical to SEQ ID NO: 68084

SEQ ID NO: 68172 - protein, 518 aa, Homo sapiens; identical to SEQ ID NO: 68072

SEQ ID NO: 68173 - protein, 518 aa, Homo sapiens; identical to SEQ ID NO: 68072

SEQ ID NO: 68174 - protein, 488 aa, Homo sapiens; identical to SEQ ID NO: 68145

SEQ ID NO: 68175 - protein, 488 aa, Homo sapiens; identical to SEQ ID NO: 68145

SEQ ID NO: 68176 - protein, 417 aa, Homo sapiens; identical to SEQ ID NO: 68084

SEQ ID NO: 68177 - protein, 630 aa, Homo sapiens
MAAVAMTPNPVQTLQEEAVCAICLDYFTDPVSIGCGHNFCRVCVTQLWGGEDEEDRDELDREEEEEDGEEEEVEAVGAGAGWDTPMRDEDYEGDMEEEVEEEEEGVFWTSGMSRSSWDNMDYVWEEEDEEEDLDYYLGDMEEEDLRGEDEEDEEEVLEEVEEEDLDPVTPLPPPPAPRRCFTCPQCRKSFPRRSFRPNLQLANMVQVIRQMHPTPGRGSRVTDQGICPKHQEALKLFCEVDEEAICVVCRESRSHKQHSVVPLEEVVQEYKAKLQGHVEPLRKHLEAVQKMKAKEERRVTELKSQMKSELAAVASEFGRLTRFLAEEQAGLERRLREMHEAQLGRAGAAASRLAEQAAQLSRLLAEAQERSQQGGLRLLQDIKETFNRCEEVQLQPPEVWSPDPCQPHSHDFLTDAIVRKMSRMFCQAARVDLTLDPDTAHPALMLSPDRRGVRLAERRQEVADHPKRFSADCCVLGAQGFRSGRHYWEVEVGGRRGWAVGAARESTHHKEKVGPGGSSVGSGDASSSRHHHRRRRLHLPQQPLLQREVWCVGTNGKRYQAQSSTEQTLLSPSEKPRRFGVYLDYEAGRLGFYNAETLAHVHTFSAAFLGERVFPFFRVLSKGTRIKLCP

SEQ ID NO: 68178 - protein, 518 aa, Homo sapiens
MAAVAMTPNPVQTLQEEAVCAICLDYFTDPVSIGCGHNFCRVCVTQLWGGEDEEDRDELDREEEEEDGEEEEVEAVGAGAGWDTPMRDEDYEGDMEEEVEEEEEGVFWTSGMSRSSWDNMDYVWEEEDEEEDLDYYLGDMEEEDLRGEDEEDEEEVLEEVEEEDLDPVTPLPPPPAPRRCFTCPQCRKSFPRRSFRPNLQLANMVQVIRQMHPTPGRGSRVTDQGICPKHQEALKLFCEVDEEAICVVCRESRSHKQHSVVPLEEVVQEYKAKLQGHVEPLRKHLEAVQKMKAKEERRVTELKSQMKSELAAVASEFGRLTRFLAEEQAGLERRLREMHEAQLGRAGAAASRLAEQAAQLSRLLAEAQERSQQGGLRLLQDIKETFNRCEEVQLQPPEVWSPDPCQPHSHDFLTDAIVRKMSRMFCQAARVDLTLDPDTAHPALMLSPDRRGVRLAERRQEVADHPKRFSADCCVLGAQGFRSGRHYWEEPKEPSWPPAQPSLTYYVCPTDRPEFSFT

SEQ ID NO: 68179 - protein, 150 aa, Homo sapiens
LQEEAVCAICLDYFTDPVSIGCGHNFCRVCVTQLWGRRGGGSGGYPVTPLPPPPAPRRCFTCPQCRKSFPRRSFRPNLQLANMVQVIRQMHPTPGRGSRVTDQGICPKHQEALKLFCEVDEEAICVVCRESRSHKQHSVVPLEEVVQEYK

SEQ ID NO: 68180 - protein, 315 aa, Homo sapiens
MKAKEERRVTELKSQMKSELAAVASEFGRLTRFLAEEQAGLERRLREMHEAQLGRAGAAASRLAEQAAQLSRLLAEAQERSQQGGLRLLQQDIKETFNRYAIVRKMSRMFCQAARVDLTLDPDTAHPALMLSPDRRGVRLAERRQEVADHPKRFSADCCVLGAQGFRSGRHYWEVEVGGRRGWAVGAARESTHHKEKVGPGGSSVGSGDASSSRHHHRRRRLHLPQQPLLQREVWCVGTNGKRYQAQSSTEQTLLSPSEKPRRFGVYLDYEAGRLGFYNAETLAHVHTFSAAFLGERVFPFFRVLSKGTRIKLCP

SEQ ID NO: 68181 - protein, 344 aa, Homo sapiens
MASGVGAAFEELPHDGTCDECEPDEAPGAEEVCRECGFCYCRRHAEAHRQKFLSHHLAEYVHGSQAWTPPADGEGAGKEEAEVKVEQEREIESEAGEESESEEESESEEESETEEESEDESDEESEEDSEEEMEDEQESEAEEDNQEEGESEAEGETEAESEFDPEIEMEAERVAKRKCPDHGLDLSTYCQEDRQLICVLCPVIGAHQGHQLSTLDEAFEELRSKDSGGLKAAMIELVERLKFKSSDPKVTRDQMKMFIQQEFKKVQKVIADEEQKALHLVDIQEAMATAHVTEILADIQSHMDRLMTQMAQAKEQLDTSNESAEPKAEGDEEGPSGASEEEDT

SEQ ID NO: 68182 - protein, 580 aa, Homo sapiens
MSENRKPLLGFVSKLTSGTALGNSGKTHCPLCLGLFKAPRLLPCLHTVCTTCLEQLEPFSVVDIRGGDSDTSSEGSIFQELKPRSLQSQIGILCPVCDAQVDLPMGGVKALTIDHLAVNDVMLESLRGEGQGLVCDLCNDREVEKRCQTCKANLCHFCCQAHRRQKKTTYHTMVDLKDLKGYSRIGKPILCPVHPAEELRLFCEFCDRPVCQDCVVGEHREHPCDFTSNVIHKHGDSVWELLKGTQPHVEALEEALAQIHIINSALQKRVEAVAADVRTFSEGYIKAIEEHRDKLLKQLEDIRAQKENSLQLQKAQLEQLLADMRTGVEFTEHLLTSGSDLEILITKRVVVERLRKLNKVQYSTRPGVNDKIRFCPQEKAGQCRGYEIYGTINTKEVDPAKCVLQGEDLHRAREKQTASFTLLCKDAAGEIMGRGGDNVQVAVVPKDKKDSPVRTMVQDNKDGTYYISYTPKEPGVYTVWVCIKEQHVQGSPFTVMVRRKHRPHSGVFHCCTFCSSGGQKTARCACGGTMPGGYLGCGHGHKGHPGHPHWSCCGKFNEKSECTWTGGQSAPRSLLRTVAL

SEQ ID NO: 68183 - protein, 523 aa, Homo sapiens
MLSGVTLEGGGARSGEGRRSRTELKPRSLQSQIGILCPVCDAQVDLPMGGVKALTIDHLAVNDVMLESLRGEGQGLVCDLCNDREVEKRCQTCKANLCHFCCQAHRRQKKTTYHTMVDLKDLKGYSRIGKPILCPVHPAEELRLFCEFCDRPVCQDCVVGEHREHPCDFTSNVIHKHGDSVWELLKGTQPHVEALEEALAQIHIINSALQKRVEAVAADVRTFSEGYIKAIEEHRDKLLKQLEDIRAQKENSLQLQKAQLEQLLADMRTGVEFTEHLLTSGSDLEILITKRVVVERLRKLNKVQYSTRPGVNDKIRFCPQEKAGQCRGYEIYGTINTKEVDPAKCVLQGEDLHRAREKQTASFTLLCKDAAGEIMGRGGDNVQVAVVPKDKKDSPVRTMVQDNKDGTYYISYTPKEPGVYTVWVCIKEQHVQGSPFTVMVRRKHRPHSGVFHCCTFCSSGGQKTARCACGGTMPGGYLGCGHGHKGHPGHPHWSCCGKFNEKSECTWTGGQSAPRSLLRTVAL

SEQ ID NO: 68184 - protein, 562 aa, Homo sapiens
MSENRKPLLGFVSKLTSGTALGNSGKTHCPLCLGLFKAPRLLPCLHTVCTTCLEQLEPFSVVDIRGGDSDTSSEGSIFQELKPRSLQSQIGILCPVCDAQVDLPMGGVKALTIDHLAVNDVMLESLRGEGQGLVCDLCNDREVEKRCQTCKANLCHFCCQAHRRQKKTTYHTMVDLKDLKGYSRIGKPILCPVHPAEELRLFCEFCDRPVCQDCVVGEHREHPCDFTSNVIHKHGDSVWELLKGTQPHVEALEEALAQIHIINSALQKRVEAVAADVRTFSEGYIKAIEEHRDKLLKQLEDIRAQKENSLQLQKAQLEQLLADMRTGVEFTEHLLTSGSDLEILITKRVVVERLRKLNKVQYSTRPGVNDKIRFCPQEKAGQCRGYEIYDLHRAREKQTASFTLLCKDAAGEIMGRGGDNVQVAVVPKDKKDSPVRTMVQDNKDGTYYISYTPKEPGVYTVWVCIKEQHVQGSPFTVMVRRKHRPHSGVFHCCTFCSSGGQKTARCACGGTMPGGYLGCGHGHKGHPGHPHWSCCGKFNEKSECTWTGGQSAPRSLLRTVAL

SEQ ID NO: 68185 - protein, 638 aa, Homo sapiens
MDGSGPFSCPICLEPLREPVTLPCGHNFCLACLGALWPHRGASGAGGPGGAARCPLCQEPFPDGLQLRKNHTLSELLQLRQGSGPGSGPGPAPALAPEPSAPSALPSVPEPSAPCAPEPWPAGEEPVRCDACPEGAALPAALSCLSCLASFCPAHLGPHERSPALRGHRLVPPLRRLEESLCPRHLRPLERYCRAERVCLCEACAAQEHRGHELVPLEQERALQEAEQSKVLSAVEDRMDELGAGIAQSRRTVALIKSAAVAERERVSRLFADAAAALQGFQTQVLGFIEEGEAAMLGRSQGDLRRQEEQRSRLSRARQNLSQVPEADSVSFLQELLALRLALEDGCGPGPGPPRELSFTKSSQAVRAVRDMLAVACVNQWEQLRGPGGNEDGPQKLDSEADAEPQDLESTNLLESEAPRDYFLKFAYIVDLDSDTADKFLQLFGTKGVKRVLCPINYPLSPTRFTHCEQVLGEGALDRGTYYWEVEIIEGWVSMGVMAEDFSPQEPYDRGRLGRNAHSCCLQWNGRSFSVWFHGLEAPLPHPFSPTVGVCLEYADRALAFYAVRDGKMSLLRRLKASRPRRGGIPASPIDPFQSRLDSHFAGLFTHRLKPAFFLESVDAHLQIGPLKKSCISVLKRR

SEQ ID NO: 68186 - protein, 493 aa, Homo sapiens
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQKVSGKILRTENVTLKKPETFPKNQRRVFRAPDLKGMLEVFRELTDVRRYWVDVTVAPNNISCAVISEDKRQVSSPKPQIIYGARGTRYQTFVNFNYCTGILGSQSITSGKHYWEVDVSKKTAWILGVCAGFQPDAMCNIEKNENYQPKYGYWVIGLEEGVKCSAFQDSSFHTPSVPFIVPLSVIICPDRVGVFLDYEACTVSFFNITNHGFLIYKFSHCSFSQPVFPYLNPRKCGVPMTLCSPSS

SEQ ID NO: 68187 - protein, 326 aa, Homo sapiens
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQGVDGVIKRTENVTLKKPETFPKNQRRVFRAPDLKGMLEVFRELTDVRRYWGWSAMARSRFTATSTSQIQAILLPQPPK

SEQ ID NO: 68188 - protein, 493 aa, Homo sapiens
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQGVDGVIKRTENVTLKKPETFPKNQRRVFRAPDLKGMLEVFRELTDVRRYWVDVTVAPNNISCAVISEDKRQVSSPKPQIIYGARGTRYQTFVNFNYCTGILGSQSITSGKHYWEVDVSKKTAWILGVCAGFQPDAMCNIEKNENYQPKYGYWVIGLEEGVKCSAFQDSSFHTPSVPFIVPLSVIICPDRVGVFLDYEACTVSFFNITNHGFLIYKFSHCSFSQPVFPYLNPRKCGVPMTLCSPSS

SEQ ID NO: 68189 - protein, 347 aa, Homo sapiens
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQGVDGVIKRTENVTLKKPETFPKNQRRVFRAPDLKGMLEVFRELTDVRRYWGKEKSHYHKPPCGLSLLLSLSFRILCSLLGSCFKIYDSPSKTHITYPSL

SEQ ID NO: 68190 - protein, 327 aa, Homo sapiens
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQAGVQCLILRTENVTLKKPETFPKNQRRVFRAPDLKGMLEVFRELTDVRRYWGWSAMARSRFTATSTSQIQAILLPQPPK

SEQ ID NO: 68191 - protein, 326 aa, Homo sapiens; identical to SEQ ID NO: 68187

SEQ ID NO: 68192 - protein, 209 aa, Homo sapiens
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEED

SEQ ID NO: 68193 - protein, 72 aa, Homo sapiens
MASGILVNVKEEVTCPICLELLTQPLSLDCGHSFCQACLTANHKKSMLDKGESSCPVCRISYQPENIRPNRH

SEQ ID NO: 68194 - protein, 271 aa, Homo sapiens
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQDGERDLEEARNFSKKSKESVSSS

SEQ ID NO: 68195 - protein, 487 aa, Homo sapiens
MAWQVSLLELEDWLQCPICLEVFKEPLMLQCGHSYCKGCLVSLSCHLDAELRCPVCRQAVDGSSSLPNVSLARVIEALRLPGDPEPKVCVHHRNPLSLFCEKDQELICGLCGLLGSHQHHPVTPVSTVYSRMKEELAALISELKQEQKKVDELIAKLVNNRTRIVNESDVFSWVIRREFQELHHLVDEEKARCLEGIGGHTRGLVASLDMQLEQAQGTRERLAQAECVLEQFGNEDHHKFIRKFHSMASRAEMPQARPLEGAFSPISFKPGLHQADIKLTVWKRLFRKVLPAPEPLKLDPATAHPLLELSKGNTVVQCGLLAQRRASQPERFDYSTCVLASRGFSCGRHYWEVVVGSKSDWRLGVIKGTASRKGKLNRSPEHGVWLIGLKEGRVYEAFACPRVPLPVAGHPHRIGLYLHYEQGELTFFDADRPDDLRPLYTFQADFQGKLYPILDTCWHERGSNSLPMVLPPPSGPGPLSPEQPTKL

SEQ ID NO: 68196 - protein, 487 aa, Homo sapiens; identical to SEQ ID NO: 68195

SEQ ID NO: 68197 - protein, 488 aa, Homo sapiens
MTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 68198 - protein, 516 aa, Homo sapiens
MCGSERILQAGNILEIRVGQAGARRVATMTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 68199 - protein, 462 aa, Homo sapiens
MTSPVLVDIREEVTCPICLELLTEPLSIDCGHSFCQACITPNGRESVIGQEGERSCPVCQTSYQPGNLRPNRHLANIVRRLREEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 68200 - protein, 395 aa, Homo sapiens
MCGSERPWRKTAALLSGGWEGHLLACERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 68201 - protein, 313 aa, Homo sapiens
MEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 68202 - protein, 313 aa, Homo sapiens; identical to SEQ ID NO: 68201

SEQ ID NO: 68203 - protein, 313 aa, Homo sapiens; identical to SEQ ID NO: 68201

SEQ ID NO: 68204 - protein, 313 aa, Homo sapiens; identical to SEQ ID NO: 68201

SEQ ID NO: 68205 - protein, 1216 aa, Homo sapiens
MARNCSECKEKRAAHILCTYCNRWLCSSCTEEHRHSPVPGGPFFPRAQKGSPGVNGGPGDFTLYCPLHTQEVLKLFCETCDMLTCHSCLVVEHKEHRCRHVEEVLQNQRMLLEGVTTQVAHKKSSLQTSAKQIEDRIFEVKHQHRKVENQIKMAKMVLMNELNKQANGLIEELEGITNERKRKLEQQLQSIMVLNRQFEHVQNFINWAVCSKTSVPFLFSKELIVFQMQRLLETSCNTDPGSPWSIRFTWEPNFWTKQLASLGCITTEGGQMSRADAPAYGGLQGSSPFYQSHQSPVAQQEALSHPSHKFQSPAVCSSSVCCSHCSPVSPSLKGQVPPPSIHPAHSFRQPPEMVPQQLGSLQCSALLPREKELACSPHPPKLLQPWLETQPPVEQESTSQRLGQQLTSQPVCIVPPQDVQQGAHAQPTLQTPSIQVQFGHHQKLKLSHFQQQPQQQLPPPPPPLPHPPPPLPPPPQQPHPPLPPSQHLASSQHESPPGPACSQNMDIMHHKFELEEMQKDLELLLQAQQPSLQLSQTKSPQHLQQTIVGQINYIVRQPAPVQSQSQEETLQATDEPPASQGSKPALPLDKNTAAALPQASGEETPLSVPPVDSTIQHSSPNVVRKHSTSLSIMGFSNTLEMELSSTRLERPLEPQIQSVSNLTAGAPQAVPSLLSAPPKMVSSLTSVQNQAMPSLTTSHLQTVPSLVHSTFQSMPNLISDSPQAMASLASDHPQAGPSLMSGHTQAVPSLATCPLQSIPPVSDMQPETGSSSSSGRTSGSLCPRDGADPSLENALCKVKLEEPINLSVKKPPLAPVVSTSTALQQYQNPKECENFEQGALELDAKENQSIRAFNSEHKIPYVRLERLKICAASSGEMPVFKLKPQKNDQDGSFLLIIECGTESSSMSIKVSQDRLSEATQAPGLEGRKVTVTSLAGQRPPEVEGTSPEEHRLIPRTPGAKKGPPAPIENEDFCAVCLNGGELLCCDRCPKVFHLSCHVPALLSFPGGEWVCTLCRSLTQPEMEYDCENACYNQPGMRASPGLSMYDQKKCEKLVLSLCCNNLSLPFHEPVSPLARHYYQIIKRPMDLSIIRRKLQKKDPAHYTTPEEVVSDVRLMFWNCAKFNYPDSEVAEAGRCLEVFFEGWLKEIYPEKRFAQPRQEDSDSEEVSSESGCSTPQGFPWPPYMQEGIQPKRRRRHMENERAKRMSFRLANSISQV

SEQ ID NO: 68206 - protein, 485 aa, Homo sapiens
MDPTALVEAIVEEVACPICMTFLREPMSIDCGHSFCHSCLSGLWEIPGESQNWGYTCPLCRAPVQPRNLRPNWQLANVVEKVRLLRLHPGMGLKGDLCERHGEKLKMFCKEDVLIMCEACSQSPEHEAHSVVPMEDVAWEYKWELHEALEHLKKEQEEAWKLEVGERKRTATWKIQVETRKQSIVWEFEKYQRLLEKKQPPHRQLGAEVAAALASLQREAAETMQKLELNHSELIQQSQVLWRMIAELKERSQRPVRWMLQDIQEVLNRSKSWSLQQPEPISLELKTDCRVLGLREILKTYAADVRLDPDTAYSRLIVSEDRKRVHYGDTNQKLPDNPERFYRYNIVLGSQCISSGRHYWEVEVGDRSEWGLGVCKQNVDRKEVVYLSPHYGFWVIRLRKGNEYRAGTDEYPILSLPVPPRRVGIFVDYEAHDISFYNVTDCGSHIFTFPRYPFPGRLLPYFSPCYSIGTNNTAPLAICSLDGED

SEQ ID NO: 68207 - protein, 206 aa, Homo sapiens
MQKLELKTDCRVLGLREILKTYAADVRLDPDTAYSRLIVSEDRKRVHYGDTNQKLPDNPERFYRYNIVLGSQCISSGRHYWEVEVGDRSEWGLGVCKQNVDRKEVVYLSPHYGFWVIRLRKGNEYRAGTDEYPILSLPVPPRRVGIFVDYEAHDISFYNVTDCGSHIFTFPRYPFPGRLLPYFSPCYSIGTNNTAPLAICSLDGED

SEQ ID NO: 68208 - protein, 511 aa, Homo sapiens
MAAVGPRTGPGTGAEALALAAELQGEATCSICLELFREPVSVECGHSFCRACIGRCWERPGAGSVGAATRAPPFPLPCPQCREPARPSQLRPNRQLAAVATLLRRFSLPAAAPGEHGSQAAAARAAAARCGQHGEPFKLYCQDDGRAICVVCDRAREHREHAVLPLDEAVQEAKELLESRLRVLKKELEDCEVFRSTEKKESKELLKQMAAEQEKVGAEFQALRAFLVEQEGRLLGRLEELSREVAQKQNENLAQLGVEITQLSKLSSQIQETAQKPDLDFLQEFKSTLSRCSNVPGPKPTTVSSEMKNKVWNVSLKTFVLKGMLKKFKEDLRGELEKEEKVELTLDPDTANPRLILSLDLKGVRLGERAQDLPNHPCRFDTNTRVLASCGFSSGRHHWEVEVGSKDGWAFGVARESVRRKGLTPFTPEEGVWALQLNGGQYWAVTSPERSPLSCGHLSRVRVALDLEVGAVSFYAVEDMRHLYTFRVNFQERVFPLFSVCSTGTYLRIWP

SEQ ID NO: 68209 - protein, 221 aa, Homo sapiens
MAAVGPRTGPGTGAEALALAAELQGEATCSICLELFREPVSVECGHSFCRACIGRCWERPGAGSVGAATRAPPFPLPCPQCREPARPSQLRPNRQLAAVATLLRRFSLPAAAPGEHGSQAAAARAAAARCGQHGEPFKLYCQDDGRAICVVCDRAREHREHAVLPLDEAVQEAKELLESRLRVLKKELEDCEVFRSTEKKESKELLVSQAPAGPPWDITEA

SEQ ID NO: 68210 - protein, 303 aa, Homo sapiens
MAAEQEKVGAEFQALRAFLVEQEGRLLGRLEELSREVAQKQNENLAQLGVEITQLSKLSSQIQETAQKPDLDFLQEFKSTLSRCSNVPGPKPTTVSSEMKNKVWNVSLKTFVLKGMLKKFKEDLRGELEKEEKVELTLDPDTANPRLILSLDLKGVRLGERAQDLPNHPCRFDTNTRVLASCGFSSGRHHWEVEVGSKDGWAFGVARESVRRKGLTPFTPEEGVWALQLNGGQYWAVTSPERSPLSCGHLSRVRVALDLEVGAVSFYAVEDMRHLYTFRVNFQERVFPLFSVCSTGTYLRIWP

SEQ ID NO: 68211 - protein, 303 aa, Homo sapiens; identical to SEQ ID NO: 68210

SEQ ID NO: 68212 - protein, 329 aa, Homo sapiens
MTQATGQMLCLHVQVPLQLLLLGQKQMAAEQEKVGAEFQALRAFLVEQEGRLLGRLEELSREVAQKQNENLAQLGVEITQLSKLSSQIQETAQKPDLDFLQEFKSTLSRCSNVPGPKPTTVSSEMKNKVWNVSLKTFVLKGMLKKFKEDLRGELEKEEKVELTLDPDTANPRLILSLDLKGVRLGERAQDLPNHPCRFDTNTRVLASCGFSSGRHHWEVEVGSKDGWAFGVARESVRRKGLTPFTPEEGVWALQLNGGQYWAVTSPERSPLSCGHLSRVRVALDLEVGAVSFYAVEDMRHLYTFRVNFQERVFPLFSVCSTGTYLRIWP

SEQ ID NO: 68213 - protein, 303 aa, Homo sapiens; identical to SEQ ID NO: 68210

SEQ ID NO: 68214 - protein, 477 aa, Homo sapiens
MSAAPGLLHQELSCPLCLQLFDAPVTAECGHSFCRACLGRVAGEPAADGTVLCPCCQAPTRPQALSTNLQLARLVEGLAQVPQGHCEEHLDPLSIYCEQDRALVCGVCASLGSHRGHRLLPAAEAHARLKTQLPQQKLQLQEACMRKEKSVAVLEHQLVEVEETVRQFRGAVGEQLGKMRVFLAALEGSLDREAERVRGEAGVALRRELGSLNSYLEQLRQMEKVLEEVADKPQTEFLMKYCLVTSRLQKILAESPPPARLDIQLPIISDDFKFQVWRKMFRALMPALEELTFDPSSAHPSLVVSSSGRRVECSEQKAPPAGEDPRQFDKAVAVVAHQQLSEGEHYWEVDVGDKPRWALGVIAAEAPRRGRLHAVPSQGLWLLGLREGKILEAHVEAKEPRALRSPERRPTRIGLYLSFGDGVLSFYDASDADALVPLFAFHERLPRPVYPFFDVCWHDKGKNAQPLLLVGPEGAEA

SEQ ID NO: 68215 - protein, 250 aa, Homo sapiens
MAWQVSLLELEDRLQCPICLEVFKESLMLQCGHSYCKGCLVSLSYHLDTKVRCPMCWQVVDGSSSLPNVSLAWVIEALRLPGDPEPKVCVHHRNPLSLFCEKDQELICGLCGLLGSHQHHPVTPVSTVCSRMKEELAALFSELKQEQKKVDELIAKLVKNRTRIVNESDVFSWVIRREFQELRHPVDEEKARCLEGIGGHTRGLVASLDMQLEQAQGTRERLAQAECVLEQFGNEDHHEFIWKFHSMASR

SEQ ID NO: 68216 - protein, 282 aa, Homo sapiens
MAWQVSLLELEDRLQCPICLEVFKESLMLQCGHSYCKGCLVSLSYHLDTKVRCPMCWQVVDGSSSLPNVSLAWVIEALRLPGDPEPKVCVHHRNPLSLFCEKDQELICGLCGLLGSHQHHPVTPVSTVCSRMKEELAALFSELKQEQKKVDELIAKLVKNRTRIVNESDVFSWVIRREFQELRHPVDEEKARCLEGIGGHTRGLVASLDMQLEQAQGTRERLAQAECVLEQFGNEDHHEFIWKFHSMASRLTKTEELEKKWRNGLAASHSLPQQVRPQRRTP

SEQ ID NO: 68217 - protein, 250 aa, Homo sapiens; identical to SEQ ID NO: 68215

SEQ ID NO: 68218 - protein, 249 aa, Homo sapiens
MAWQVSLLELEDRLQCPICLEVFKESLMLQCGHSYCKGCLVSLSYHLDTKVRCPMCWQVVDGSSSLPNVSLAWVIEALRLPGDPEPKVCVHHRNPLSLFCEKDQELICGLCGLLGSHQHHPVTPVSTVCSRMKEELAALFSELKQEQKKVDELIAKLVKNRTRIVNESDVFSWVIRREFQELRHPVDEEKARCLEGIGGHTRGLVASLDMQLEQAQGTRERLAQAECVLEQFGNEDHHEFIWFHSMASR

SEQ ID NO: 68219 - protein, 250 aa, Homo sapiens
MAWQVSLLELEDWLQCPICLEVFKESLMLQCGHSYCKGCLVSLSYHLDTKVRCPMCWQVVDGSSSLPNVSLAWVIEALRLPGDPEPKVCVHHRNPLSLFCEKDQELICGLCGLLGSHQHHPVTPVSTVCSRMKEELAALFSELKQEQKKVDELIAKLVKNRTRIVNESDVFSWVIRREFQELRHPVDEEKARCLEGIGGHTRGLVASLDMQLEQAQGTRERLAQAECVLEQFGNEDHHEFIWKFHSMASR

SEQ ID NO: 68220 - protein, 249 aa, Homo sapiens
MAWQVSLLELEDWLQCPICLEVFKESLMLQCGHSYCKGCLVSLSYHLDTKVRCPMCWQVVDGSSSLPNVSLAWVIEALRLPGDPEPKVCVHHRNPLSLFCEKDQELICGLCGLLGSHQHHPVTPVSTVCSRMKEELAALFSELKQEQKKVDELIAKLVKNRTRIVNESDVFSWVIRREFQELRHPVDEEKARCLEGIGGHTRGLVASLDMQLEQAQGTRERLAQAECVLEQFGNEDHHEFIWFHSMASR

SEQ ID NO: 68221 - protein, 551 aa, Homo sapiens
MAENWKNCFEEELICPICLHVFVEPVQLPCKHNFCRGCIGEAWAKDSGLVRCPECNQAYNQKPGLEKNLKLTNIVEKFNALHVEKPPAALHCVFCRRGPPLPAQKVCLRCEAPCCQSHVQTHLQQPSTARGHLLVEADDVRAWSCPQHNAYRLYHCEAEQVAVCQYCCYYSGAHQGHSVCDVEIRRNEIRKMLMKQQDRLEEREQDIEDQLYKLESDKRLVEEKVNQLKEEVRLQYEKLHQLLDEDLRQTVEVLDKAQAKFCSENAAQALHLGERMQEAKKLLGSLQLLFDKTEDVSFMKNTKSVKILMDRTQTCTSSSLSPTKIGHLNSKLFLNEVAKKEKQLRKMLEGPFSTPVPFLQSVPLYPCGVSSSGAEKRKHSTAFPEASFLETSSGPVGGQYGAAGTASGEGQSGQPLGPCSSTQHLVALPGGAQPVHSSPVFPPSQYPNGSAAQQPMLPQYGGRKILVCSVDNCYCSSVANHGGHQPYPRSGHFPWTVPSQEYSHPLPPTPSVPQSLPSLAVRDWLDASQQPGHQDFYRVYGQPSTKHYVTS

SEQ ID NO: 68222 - protein, 550 aa, Homo sapiens
MAENWKNCFEEELICPICLHVFVEPVQLPCKHNFCRGCIGEAWAKDSGLVRCPECNQAYNQKPGLEKNLKLTNIVEKFNALHVEKPPAALHCVFCRRGPPLPAQKVCLRCEAPCCQSHVQTHLQQPSTARGHLLVEADDVRAWSCPQHNAYRLYHCEAEQVAVCQYCCYYSGAHQGHSVCDVEIRRNEIRMLMKQQDRLEEREQDIEDQLYKLESDKRLVEEKVNQLKEEVRLQYEKLHQLLDEDLRQTVEVLDKAQAKFCSENAAQALHLGERMQEAKKLLGSLQLLFDKTEDVSFMKNTKSVKILMDRTQTCTSSSLSPTKIGHLNSKLFLNEVAKKEKQLRKMLEGPFSTPVPFLQSVPLYPCGVSSSGAEKRKHSTAFPEASFLETSSGPVGGQYGAAGTASGEGQSGQPLGPCSSTQHLVALPGGAQPVHSSPVFPPSQYPNGSAAQQPMLPQYGGRKILVCSVDNCYCSSVANHGGHQPYPRSGHFPWTVPSQEYSHPLPPTPSVPQSLPSLAVRDWLDASQQPGHQDFYRVYGQPSTKHYVTS

SEQ ID NO: 68223 - protein, 710 aa, Homo sapiens
MEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKEATVMCEQCDVFYCDPCRLRCHPPRGPLAKHRLVPPAQGRVSRRLSPRKVSTCTDHELENHSMYCVQCKMPVCYQCLEEGKHSSHEVKALGAMWKLHKSQLSQALNGLSDRAKEAKEFLVQLRNMVQQIQENSVEFEACLVAQCDALIDALNRRKAQLLARVNKEHEHKLKVVRDQISHCTVKLRQTTGLMEYCLEVIKENDPSGFLQISDALIRRVHLTEDQWGKGTLTPRMTTDFDLSLDNSPLLQSIHQLDFVQVKASSPVPATPILQLEECCTHNNSATLSWKQPPLSTVPADGYILELDDGNGGQFREVYVGKETMCTVDGLHFNSTYNARVKAFNKTGVSPYSKTLVLQTSEVAWFAFDPGSAHSDIILSNDNLTVTCSSYDDRVVLGKTGFSKGIHYWELTVDRYDNHPDPAFGVARMDVMKDVMLGKDDKAWAMYVDNNRSWFMHNNSHTNRTEGGITKGATIGVLLDLNRKNLTFFINDEQQGPIAFDNVEGLFFPAVSLNRNVQVTLHTGLPVPDFYSSRASIA

SEQ ID NO: 68224 - protein, 802 aa, Homo sapiens
MEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKEATVMCEQCDVFYCDPCRLRCHPPRGPLAKHRLVPPAQGRVSRRLSPRKVSTCTDHELENHSMYCVQCKMPVCYQCLEEGKHSSHEVKALGAMWKLHKSQLSQALNGLSDRAKEAKEFLVQLRNMVQQIQENSVEFEACLVAQCDALIDALNRRKAQLLARVNKEHEHKLKVVRDQISHCTVKLRQTTGLMEYCLEVIKENDPSGFLQISDALIRRVHLTEDQWGKGTLTPRMTTDFDLSLDNSPLLQSIHQLDFVQVKVPATPILQLEECCTHNNSATLSWKQPPLSTVPADGYILELDDGNGGQFREVYVGKETMCTVDGLHFNSTYNARVKAFNKTGVSPYSKTLVLQTSEDTDSEEQTLPFPVPSERLPLRRMSPFSSTLNLQPSFPGRSYFDFRSSPHQLSLHSSLQSLNAPGCNFETQSAPYSQLVDIKKLLAVAWFAFDPGSAHSDIILSNDNLTVTCSSYDDRVVLGKTGFSKGIHYWELTVDRYDNHPDPAFGVARMDVMKDVMLGKDDKAWAMYVDNNRSWFMHNNSHTNRTEGGITKGATIGVLLDLNRKNLTFFINDEQQGPIAFDNVEGLFFPAVSLNRNVQVSTLPLRLNSCCWLPVQRLPRAVQSNRREGS

SEQ ID NO: 68225 - protein, 550 aa, Homo sapiens
MEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKEATVMCEQCDVFYCDPCRLRCHPPRGPLAKHRLVPPAQGRVSRRLSPRKVSTCTDHELENHSMYCVQCKMPVCYQCLEEGKHSSHEVKALGAMWKLHKSQLSQALNGLSDRAKEAKEFLVQLRNMVQQIQENSVEFEACLVAQCDALIDALNRRKAQLLARVNKEHEHKLKVVRDQISHCTVKLRQTTGLMEYCLEVIKENDPSGFLQISDALIRRVHLTEDQWGKGTLTPRMTTDFDLSLDNSPLLQSIHQLDFVQVKASSPVPATPILQLEECCTHNNSATLSWKQPPLSTVPADGYILELDDGNGGQFREVYVGKETMCTVDGLHFNSTYNARVKAFNKTGVSPYSKTLVLQTSEGKALQQYPSERELRGI

SEQ ID NO: 68226 - protein, 1249 aa, Homo sapiens
MATAATEEPFPFHGLLPKKETGAASFLCRYPEYDGRGVLIAVLDTGVDPGAPGMQVTTDGKPKIVDIIDTTGSGDVNTATEVEPKDGEIVGLSGRVLKIPASWTNPSGKYHIGIKNGYDFYPKALKERIQKERKEKIWDPVHRVALAEACRKQEEFDVANNGSSQANKLIKEELQSQVELLNSFEKKYSDPGPVYDCLVWHDGEVWRACIDSNEDGDLSKSTVLRNYKEAQEYGSFGTAEMLNYSVNIYDDGNLLSIVTSGGAHGTHVASIAAGHFPEEPERNGVAPGAQILSIKIGDTRLSTMETGTGLIRAMIEVINHKCDLVNYSYGEATHWPNSGRICEVINEAVWKHNIIYVSSAGNNGPCLSTVGCPGGTTSSVIGVGAYVSPDMMVAEYSLREKLPANQYTWSSRGPSADGALGVSISAPGGAIASVPNWTLRGTQLMNGTSMSSPNACGGIALILSGLKANNIDYTVHSVRRALENTAVKADNIEVFAQGHGIIQVDKAYDYLVQNTSFANKLGFTVTVGNNRGIYLRDPVQVAAPSDHGVGIEPVFPENTENSEKISLQLHLALTSNSSWVQCPSHLELMNQCRHINIRVDPRGLREGLHYTEVCGYDIASPNAGPLFRVPITAVIAAKVNESSHYDLAFTDVHFKPGQIRRHFIEVPEGATWAEVTVCSCSSEVSAKFVLHAVQLVKQRAYRSHEFYKFCSLPEKGTLTEAFPVLGGKAIEFCIARWWASLSDVNIDYTISFHGIVCTAPQLNIHASEGINRFDVQSSLKYEDLAPCITLKNWVQTLRPVSAKTKPLGSRDVLPNNRQLYEMVLTYNFHQPKSGEVTPSCPLLCELLYESEFDSQLWIIFDQNKRQMGSGDAYPHQYSLKLEKGDYTIRLQIRHEQISDLERLKDLPFIVSHRLSNTLSLDIHENHSFALLGKKKSSNLTLPPKYNQPFFVTSLPDDKIPKGAGPGCYLAGSLTLSKTELGKKADVIPVHYYLIPPPTKTKNGSKDKEKDSEKEKDLKEEFTEALRDLKIQWMTKLDSSDIYNELKETYPNYLPLYVARLHQLDAEKERMKRLNEIVDAANAVISHIDQTALAVYIAMKTDPRPDAATIKNDMDKQKSTLVDALCRKGCALADHLLHTQAQDGAISTDAEGKEEEGESPLDSLAETFWETTKWTDLFDNKVLTFAYKHALVNKMYGRGLKFATKLVEEKPTKENWKNCIQLMKLLGWTHCASFTENWLPIMYPPDYCVF

SEQ ID NO: 68227 - protein, 596 aa, Homo sapiens
MLPSQAQGLLWWVFPLFPASSLSYPPVSYRADGLARNTFLKACSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 68228 - protein, 3097 aa, Homo sapiens
MSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSGTSTPGPSLPPPGAAPEAGPSAPSRRPPGADAEGSEREAEPIPKMKVLESPRKGAANASGSSPDAPAKDARASLGTLPLGKPRAGAASPLNSPLSSAVPSLGKEPFPPSSPLQKGGSFWSSIPASPASRPGSFTFPGDSDSLQRQTPRHAAPGKDTDRMSTCSSASEQSVQSTQSNGSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 68229 - protein, 2500 aa, Homo sapiens
MLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSGTSTPGPSLPPPGAAPEAGPSAPSRRPPGADAEGSEREAEPIPKMKVLESPRKGAANASGSSPDAPAKDARASLGTLPLGKPRAGAASPLNSPLSSAVPSLGKEPFPPSSPLQKGGSFWSSIPASPASRPGSFTFPGDSDSLQRQTPRHAAPGKDTDRMSTCSSASEQSVQSTQSNGSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRANWNNWSPY

SEQ ID NO: 68230 - protein, 2921 aa, Homo sapiens
MSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSESESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 68231 - protein, 255 aa, Homo sapiens
MALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGRVVALCHRFKETFREICWF

SEQ ID NO: 68232 - protein, 400 aa, Homo sapiens
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSGPPSAPAEDRSGTPDSIASSSSAAHPPGVQPQQPPYTGAQTQAGQIEGQMYQQYQQQAGYGAQQPQAPPQQPQQYGIQYSASYSQQTGPQQPQQFQGYGQQPTSQAPAPAFSGQPQQLPAQPPQQYQASNYPAQTYTAQTSQPTNYTVAPASQPGMAPSQPGAYQPRPGFTSLPGSTMTPPPSGPNPYARNRPPFGQGYTQPGPGYR

SEQ ID NO: 68233 - protein, 366 aa, Homo sapiens
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSGPPSAPAEDRSGTPDSIASSSSAAHPPGVQPQQPPYTGAQTQAGQMYQQYSNRPAMVHSSRRLHLSSLNSMVFSIQQAIVSRLDLNNLSSSRDMASNQLPRHQLLPFLVSLNNCLLSRHSSTRRAIILHKLTLPKLLSLLIILWLLPLNLEWLQANLGPINQDQVLLHFLEVP

SEQ ID NO: 68234 - protein, 157 aa, Homo sapiens
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQS

SEQ ID NO: 68235 - protein, 128 aa, Homo sapiens
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGE

SEQ ID NO: 68236 - protein, 181 aa, Homo sapiens
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNV

SEQ ID NO: 68237 - protein, 400 aa, Homo sapiens; identical to SEQ ID NO: 68232

SEQ ID NO: 68238 - protein, 396 aa, Homo sapiens
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSGPPSAPAEDRSGTPDSIASSSSAAHPPGVQPQQPPYTGAQTQAGQMYQQYQQQAGYGAQQPQAPPQQPQQYGIQYSASYSQQTGPQQPQQFQGYGQQPTSQAPAPAFSGQPQQLPAQPPQQYQASNYPAQTYTAQTSQPTNYTVAPASQPGMAPSQPGAYQPRPGFTSLPGSTMTPPPSGPNPYARNRPPFGQGYTQPGPGYR

SEQ ID NO: 68239 - protein, 630 aa, Homo sapiens
MQGSSLWLSLTFRSARVLSRARFFEWQSPGLPNTAAMENGTGPYGEERPREVQETTVTEGAAKIAFPSANEVFYNPVQEFNRDLTCAVITEFARIQLGAKGIQIKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASARAKFSAACGPPVTPECEHCGQRHQLGGPMWAEPIHDLDFVGRVLEAVSANPGRFHTSERIRGVLSVITEELPDVPLYYTLDQLSSTIHCNTPSLLQLRSALLHADFRVSLSHACKNAVKTDAPASALWDIMRCWEKECPVKRERLSETSPAFRILSVEPRLQANFTIREDANPSSRQRGLKRFQANPEANWGPRPRARPGGKAADEAMEERRRLLQNKRKEPPEDVAQRAARLKTFPCKRFKEGTCQRGDQCCYSHSPPTPRVSADAAPDCPETSNQTPPGPGAAAGPGID

SEQ ID NO: 68240 - protein, 659 aa, Homo sapiens
MQGSSLWLSLTFRSARVLSRARFFEWQSPGLPNTAAMENGTGPYGEERPREVQETTVTEGAAKIAFPSANEVFYNPVQEFNRDLTCAVITEFARIQLGAKGIQIKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASASKQALVFQCVGCGAFHLQRLGKASGVPSGRAKFSAACGPPVTPECEHCGQRHQLGGPMWAEPIHDLDFVGRVLEAVSANPGRFHTSERIRGVLSVITEELPDVPLYYTLDQLSSTIHCNTPSLLQLRSALLHADFRVSLSHACKNAVKTDAPASALWDIMRCWEKECPVKRERLSETSPAFRILSVEPRLQANFTIREDANPSSRQRGLKRFQANPEANWGPRPRARPGGKAADEAMEERRRLLQNKRKEPPEDVAQRAARLKTFPCKRFKEGTCQRGDQCCYSHSPPTPRVSADAAPDCPETSNQTPPGPGAAAGPGID

SEQ ID NO: 68241 - protein, 659 aa, Homo sapiens; identical to SEQ ID NO: 68240

SEQ ID NO: 68242 - protein, 625 aa, Homo sapiens
MSENLDNEGPKPMESCGQESSSALSCPTVSVPPAAPAALEEVEKEGAGAATGPGPQPGLYSYIRDDLFTSEIFKLELQNVPRHASFSDVRRFLGRFGLQPHKTKLFGQPPCAFVTFRSAAERDKALRVLHGALWKGRPLSVRLARPKADPMARRRRQEGESEPPVTRVADVVTPLWTVPYAEQLERKQLECEQVLQKLAKEIGSTNRALLPWLLEQRHKHNKACCPLEGVRPSPQQTEYRNKCEFLVGVGVDGEDNTVGCRLGKYKGGTCAVAAPFDTVHIPEATKQVVKAFQEFIRSTPYSAYDPETYTGHWKQLTVRTSRRHQAMAIAYFHPQKLSPEELAELKTSLAQHFTAGPGRASGVTCLYFVEEGQRKTPSQEGLPLEHVAGDRCIHEDLLGLTFRISPHAFFQVNTPAAEVLYTVIQDWAQLDAGSMVLDVCCGTGTIGLALARKVKRVIGVELCPEAVEDARVNAQDNELSNVEFHCGRAEDLVPTLVSRLASQHLVAILDPPRAGLHSKVILAIRRAKNLRRLLYVSCNPRAAMGNFVDLCRAPSNRVKGIPFRPVKAVAVDLFPQTPHCEMLILFERVEHPNGTGVLGPHSPPAQPTPGPPDNTLQETGTFPSS

SEQ ID NO: 68243 - protein, 625 aa, Homo sapiens; identical to SEQ ID NO: 68242

SEQ ID NO: 68244 - protein, 562 aa, Homo sapiens
MSENLDNEGPKPMESCGQESSSALSCPTVSVPPAAPAALEEVEKEGAGAATGPGPQPGLYSYIRDDLFTSEIFKLELQNVPRHASFSDVRRFLGRFGLQPHKTKLFGQPPCAFVTFRSAAERDKALRVLHGALWKGRPLSVRLARPKADPMARRRRQEGESEPPVTRVADVVTPLWTVPYAEQLERKQLECEQVLQKLAKEIGSTNRALLPWLLEQRHKHNKACCPLEGVRPSPQQTEYRNKCEFLVGVGVDGEDNTVGCRLGKYKGGTCAVAAPFDTVHIPEATKQVVKAFQEFIRSTPYSAYDPETYTGHWKQLTVRTSRRHQAMAIAYFHPQKLSPEELAELKTSLAQHFTAGPGRASGVTCLYFVEEGQRKTPSQEGLPLEHVAGDRCIHEDLLGLTFRISPHAFFQVNTPAAEVLYTVIQDWAQLDAGSMVLDVCCGTGTIGLALARKVKRVIGVELCPEAVEDARVNAQDNELSNVEFHCGRAEDLVPTLVSRLASQHLVAILDPPRAGLHSKVILAIRRAKNLRRLLYVSCNPRAAMGNFVDAPLFPPQPLQSPI

SEQ ID NO: 68245 - protein, 509 aa, Homo sapiens
MVLWILWRPFGFSGRFLKLESHSITESKSLIPVAWTSLTQMLLEAPGIFLLGQRKRFSTMPETETHERETELFSPPSDVRGMTKLDRTAFKKTVNIPVLKVRKEIVSKLMRSLKRAALQRPGIRRVIEDPEDKESRLIMLDPYKIFTHDSFEKAELSVLEQLNVSPQISKYNLELTYEHFKSEEILRAVLPEGQDVTSGFSRIGHIAHLNLRDHQLSFKHLIGQVMIDKNPGITSAVNKINNIDNMYRNFQMEVLSGEQNMMTKVRENNYTYEFDFSKVYWNPRLSTEHSRITELLKPGDVLFDVFAGVGPFAIPVAKKNCTVFANDLNPESHKWLLYNCKLNKVDQKVKVFNLDGKDFLQGPVKEELMQLLGLSKERKPSVHVVMNLPAKAIEFLSAFKWLLDGQPCSSEFLPIVHCYSFSKDANPAEDVRQRAGAVLGISLEACSSVHLVRNVAPNKEMLCITFQIPASVLYKNQTRNPENHEDPPLKRQRTAEAFSDEKTQIVSNT

SEQ ID NO: 68246 - protein, 421 aa, Homo sapiens
MQALRHVVCALSGGVDSAVAALLLRRRGYQVTGVFMKNWDSLDEHGVCTADKDCEDAYRVCQILDIPFHQVSYVKEYWNDVFSDFLNEYEKGRTPNPDIVCNKHIKFSCFFHYAVDNLGADAIATGHYARTSLEDEEVFEQKHVKKPEGLFRNRFEVRNAVKLLQAADSFKDQTFFLSQVSQDALRRTIFPLGGLTKEFVKKIAAENRLHHVLQKKESMGMCFIGKRNFEHFLLQYLQPRPGHFISIEDNKVLGTHKGWFLYTLGQRANIGGLREPWYVVEKDSVKGDVFVAPRTDHPALYRDLLRTSRVHWIAEEPPAALVRDKMMECHFRFRHQMALVPCVLTLNQDGTVWVTAVQAVRALATGQFAVFYKGDECLGSGKILRLGPSAYTLQKGQRRAGMATESPSDSPEDGPGLSPLL

SEQ ID NO: 68247 - protein, 99 aa, Homo sapiens
MQALRHVVCALSGGVDSAVAALLLRRRGYQVTGVFMKNWDSLDEHGVCTADKDCEDAYRVCQILDIPFHQVSYVKEYWNDVFRGRCHCHRSLCKNFPGR

SEQ ID NO: 68248 - protein, 131 aa, Homo sapiens
MKNWDSLDEHGVCTADKDCEDAYRVCQILDIPFHQVSYVKEYWNDVFSDFLNEYEKGRTPNPDIVCNKHIKFSCFFHYAVDNLGADAIATGHYARTSLEDEEVFEQKHVKKPEGLFRNRFEVRNARFPRMP

SEQ ID NO: 68249 - protein, 99 aa, Homo sapiens; identical to SEQ ID NO: 68247

SEQ ID NO: 68250 - protein, 99 aa, Homo sapiens; identical to SEQ ID NO: 68247

SEQ ID NO: 68251 - protein, 99 aa, Homo sapiens; identical to SEQ ID NO: 68247

SEQ ID NO: 68252 - protein, 166 aa, Homo sapiens
MQALRHVVCALSGGVDSAVAALLLRRRGYQVTGVFMKNWDSLDEHGVCTADKDCEDAYRVCQILDIPFHQVSYVKEYWNDVFSDFLNEYEKGRTPNPDIVCNKHIKFSCFFHYAVDNLGADAIATGHYARTSLEDEEVFEQKHVKKPEGLFRNRFEVRNARFPRMP

SEQ ID NO: 68253 - protein, 345 aa, Homo sapiens
MEPLRVLELYSGVGGMHHALRESCIPAQVVAAIDVNTVANEVYKYNFPHTQLLAKTIEGITLEEFDRLSFDMILMSPPCQPFTRDLLIQTIENCGFQYQEFLLSPTSLGIPNSRLRYFLIAKLQSEPLPFQAPGQVLMEFPKIESVHPQKYAMDVENKIQEKNVEPNISFDGSIQCSGKDAILFKLETAEEIHRKNQQDSDLSVKMLKDFLEDDTDVNQYLLPPKSLLRYALLLDIVQPTCRRSVCFTKGYGSYIEGTGSVLQTAEDVQVENIYKSLTNLSQEEQITKLLILKLRYFTPKEIANLLGFPPEFGFPEKITVKQRYRLLGNSLNVHVVAKLIKILYE

SEQ ID NO: 68254 - protein, 71 aa, Homo sapiens
MEPLRVLELYSGVGGMHHALRESCIPAQVVAAIDVNTVANEVYKYNFPHTQLLAKTIEITKITKVYSFGKC

SEQ ID NO: 68255 - protein, 117 aa, Homo sapiens
MEPLRVLELYSGVGGMHHALRESCIPAQVVAAIDVNTVANEVYKYNFPHTQLLAKTIERPLDTNNRKLWLSVPRVSIISNLSWHSKFKATIFSYCKASVRAITLSSPWSGTDGVPQN

SEQ ID NO: 68256 - protein, 391 aa, Homo sapiens
MEPLRVLELYSGVGGMHHALRESCIPAQVVAAIDVNTVANEVYKYNFPHTQLLAKTIEGITLEEFDRLSFDMILMSPPCQPFTRIGRQGDMTDSRTNSFLHILDILPRLQKLPKYILLENVKGFEVSSTRDLLIQTIENCGFQYQEFLLSPTSLGIPNSRLRYFLIAKLQSEPLPFQAPGQVLMEFPKIESVHPQKYAMDVENKIQEKNVEPNISFDGSIQCSGKDAILFKLETAEEIHRKNQQDSDLSVKMLKDFLEDDTDVNQYLLPPKSLLRYALLLDIVQPTCRRSVCFTKGYGSYIEGTGSVLQTAEDVQVENIYKSLTNLSQEEQITKLLILKLRYFTPKEIANLLGFPPEFGFPEKITVKQRYRLLGNSLNVHVVAKLIKILYE

SEQ ID NO: 68257 - protein, 367 aa, Homo sapiens
MEPLRVLELYSGVGGMHHALRESCIPAQVVAAIDVNTVANEVYKYNFPHTQLLAKTIEGITLEEFDRLSFDMILMSPPCQPFTRLQKLPKYILLENVKGFEVSSTRDLLIQTIENCGFQYQEFLLSPTSLGIPNSRLRYFLIAKLQSEPLPFQAPGQVLMEFPKIESVHPQKYAMDVENKIQEKNVEPNISFDGSIQCSGKDAILFKLETAEEIHRKNQQDSDLSVKMLKDFLEDDTDVNQYLLPPKSLLRYALLLDIVQPTCRRSVCFTKGYGSYIEGTGSVLQTAEDVQVENIYKSLTNLSQEEQITKLLILKLRYFTPKEIANLLGFPPEFGFPEKITVKQRYRLLGNSLNVHVVAKLIKILYE

SEQ ID NO: 68258 - protein, 310 aa, Homo sapiens
MSTLSLMKYTSIIFLTHSYLPRRLKIGRQGDMTDSRTNSFLHILDILPRDLLIQTIENCGFQYQEFLLSPTSLGIPNSRLRYFLIAKLQSEPLPFQAPGQVLMEFPKIESVHPQKYAMDVENKIQEKNVEPNISFDGSIQCSGKDAILFKLETAEEIHRKNQQDSDLSVKMLKDFLEDDTDVNQYLLPPKSLLRYALLLDIVQPTCRRSVCFTKGYGSYIEGTGSVLQTAEDVQVENIYKSLTNLSQEEQITKLLILKLRYFTPKEIANLLGFPPEFGFPEKITVKQRYRLLGNSLNVHVVAKLIKILYE

SEQ ID NO: 68259 - protein, 434 aa, Homo sapiens
MLRCLYHWHRPVLNRRWSRLCLPKQYLFTMKLQSPEFQSLFTEGLKSLTELFVKENHELRIAGGAVRDLLNGVKPQDIDFATTATPTQMKEMFQSAGIRMINNRGEKHGTITARLHEENFEITTLRIDVTTDGRHAEVEFTTDWQKDAERRDLTINSMFLGFDGTLFDYFNGYEDLKNKKVRFVGHAKQRIQEDYLRILRYFRFYGRIVDKPGDHDPETLEAIAENAKGLAGISGERIWVELKKILVGNHVNHLIHLIYDLDVAPYIGLPANASLEEFDKVSKNVDGFSPKPVTLLASLFKVQDDVTKLDLRLKIAKEEKNLGLFIVKNRKDLIKATDSSDPLKPYQDFIIDSREPDATTRVCELLKYQGEHCLLKEMQQWSIPPFPVSGHDIRKVGISSGKEIGALLQQLREQWKKSGYQMEKDELLSYIKKT

SEQ ID NO: 68260 - protein, 414 aa, Homo sapiens
MLRCLYHWHRPVLNRRWSRLCLPKQYLFTMKLQSPEFQSLFTEGLKSLTELFVKENHELRIAGGAVRDLLNGVKPQDIDFATTATPTQMKEMFQSAGIRMINNRGEKHGTITARLHEENFEITTLRIDVTTDGRHAEVEFTTDWQKDAERRDLTINSMFLGFDGTLFDYFNGYEDLKNKKVRFVGHAKQRIQEDYLRILRYFRFYGRIVDKPGDHDPETLEAIAENAKGLAGISGERIWVELKKILVGLPANASLEEFDKVSKNVDGFSPKPVTLLASLFKVQDDVTKLDLRLKIAKEEKNLGLFIVKNRKDLIKATDSSDPLKPYQDFIIDSREPDATTRVCELLKYQGEHCLLKEMQQWSIPPFPVSGHDIRKVGISSGKEIGALLQQLREQWKKSGYQMEKDELLSYIKKT

SEQ ID NO: 68261 - protein, 57 aa, Homo sapiens
MLRCLYHWHRPVLNRRWSRLCLPKQYLFTMKLQSPEFQSLFTEGLKSLTGINAFHEN

SEQ ID NO: 68262 - protein, 57 aa, Homo sapiens; identical to SEQ ID NO: 68261

SEQ ID NO: 68263 - protein, 62 aa, Homo sapiens
MLRCLYHWHRPVLNRRWSRLCLPKQYLFTMKLQSPEFQSLFTEGLKSLTELFVKENHELRIA

SEQ ID NO: 68264 - protein, 57 aa, Homo sapiens; identical to SEQ ID NO: 68261

SEQ ID NO: 68265 - protein, 434 aa, Homo sapiens; identical to SEQ ID NO: 68259

SEQ ID NO: 68266 - protein, 253 aa, Homo sapiens
MNFSGGGRQEAAGSRGRRAPRPREQDRDVQLSKALSYALRHGALKLGLPMGADGFVPLGTLLQLPQFRGFSAEDVQRVVDTNRKQRFALQLGDPSTGLLIRANQGHSLQVPKLELMPLETPQALPPMLVHGTFWKHWPSILLKGLSCQGRTHIHLAPGLPGDPGIISGMRSHCEIAVFIDGPLALADGIPFFRSANGVILTPGNTDGFLLPKYFKEALQLRPTRKPLSLAGDEETECQSSPKHSSRERRRIQQ

SEQ ID NO: 68267 - protein, 255 aa, Homo sapiens
MNFSGGGRQEAAGSRGRRAPRPREQDRDVQLSKALSYALRHGALKLGLPMGADGFVPLGTLLQLPQFRGFSAEDVQRVVDTNRKQRFALQLGDPSTGLLIRANQGHSLQVGVPKLELMPLETPQALPPMLVHGTFWKHWPSILLKGLSCQGRTHIHLAPGLPGDPGIISGMRSHCEIAVFIDGPLALADGIPFFRSANGVILTPGNTDGFLLPKYFKEALQLRPTRKPLSLAGDEETECQSSPKHSSRERRRIQQ

SEQ ID NO: 68268 - protein, 204 aa, Homo sapiens
MGADGFVPLGTLLQLPQFRGFSAEDVQRVVDTNRKQRFALQLGDPSTGLLIRANQGHSLQVPKLELMPLETPQALPPMLVHGTFWKHWPSILLKGLSCQGRTHIHLAPGLPGDPGIISGMRSHCEIAVFIDGPLALADGIPFFRSANGVILTPGNTDGFLLPKYFKEALQLRPTRKPLSLAGDEETECQSSPKHSSRERRRIQQ

SEQ ID NO: 68269 - protein, 216 aa, Homo sapiens
MNFSGGGRQEAAGSRGRRAPRPREQDRDVQLSKALSYALRHGALKLGLPMGADGFVPLGTLLQLPQFRGFSAEDVQRVVDTNRKQRFALQLGDPSTGLLIRANQGHSLQVPKLELMPLETPQALPPMLVHGTFWKHWPSILLKGLSCQGRTHIHLAPGLPGDPGIISGMRSHCEIAVFIDGPLALAGKPLSLAGDEETECQSSPKHSSRERRRIQQ

SEQ ID NO: 68270 - protein, 167 aa, Homo sapiens
MGADGFVPLGTLLQLPQFRGFSAEDVQRVVDTNRKQRFALQLGDPSTGLLIRANQGHSLQVPKLELMPLETPQALPPMLVHGTFWKHWPSILLKGLSCQGRTHIHLAPGLPGDPGIISGMRSHCEIAVFIDGPLALAGKPLSLAGDEETECQSSPKHSSRERRRIQQ

SEQ ID NO: 68271 - protein, 171 aa, Homo sapiens
MEERGDSEPTPGCSGLGPGGVRGFGDGGGAPSWAPEDAWMGTHPKYLEMMELDIGDATQVYVAFLVYLDLMESKSWHEVNCVGLPELQLICLVGTEIEGEGLQTVVPTPITASLSHNRIREILKASRKLQGDPDLPMSFTLAIVESDSTIVYYKLTDGFMLPDPQNISLRR

SEQ ID NO: 68272 - protein, 129 aa, Homo sapiens
MEERGDSEPTPGCSGLGPGGVRGFGDGGGAPSWAPEDAWMGTHPKYLEMMELDIGDATQVYVAFLVYLDLMESKSWHEVNCVGLPELQLICLVGTEIEGEGLQTVVPTPITASLSHNRIFLLEDDIHVS

SEQ ID NO: 68273 - protein, 465 aa, Homo sapiens
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDHEYVLVEEAECAMSEREAAPNEELVQRNRLICRRNPYRIFEYLQLSLEEAFFLVYALGCLSIYYEKEPLTIVKLWKAFTVVQPTFRTTYMAYHYFRSKGWVPKVGLKYGTDLLLYRKGPPFYHASYSVIIELVDDHFEGSLRRPLSWKSLAALSRVSVNVSKELMLCYLIKPSTMTDKEMESPECMKRIKVQEVILSRWVSSRERSDQDDL

SEQ ID NO: 68274 - protein, 439 aa, Homo sapiens
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDHEYVLVEEAECAMSEREAAPNEEAFFLVYALGCLSIYYEKEPLTIVKLWKAFTVVQPTFRTTYMAYHYFRSKGWVPKVGLKYGTDLLLYRKGPPFYHASYSVIIELVDDHFEGSLRRPLSWKSLAALSRVSVNVSKELMLCYLIKPSTMTDKEMESPECMKRIKVQEVILSRWVSSRERSDQDDL

SEQ ID NO: 68275 - protein, 448 aa, Homo sapiens
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDHEYVLVEEAECAMSEREAAPNEELVQRNRLICRRNPYRIFEYLQLSLEEEPLTIVKLWKAFTVVQPTFRTTYMAYHYFRSKGWVPKVGLKYGTDLLLYRKGPPFYHASYSVIIELVDDHFEGSLRRPLSWKSLAALSRVSVNVSKELMLCYLIKPSTMTDKEMESPECMKRIKVQEVILSRWVSSRERSDQDDL

SEQ ID NO: 68276 - protein, 465 aa, Homo sapiens; identical to SEQ ID NO: 68273

SEQ ID NO: 68277 - protein, 439 aa, Homo sapiens; identical to SEQ ID NO: 68274

SEQ ID NO: 68278 - protein, 402 aa, Homo sapiens
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDHEYVLVEEAECAMSEREAAPNEEAFFLVYALGCLSIYYEKEPLTIVKLWKAFTVVQPTFRTTYMAYHYFRSKGWVPKVGLKYGTDLLLYRKGPPFYHASYSVIIELVDDHFEGSLRRPLSWKSLAALSRVSVNVSKVTQHQLCHWSVT

SEQ ID NO: 68279 - protein, 378 aa, Homo sapiens
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDHEYVLVEEAECAMSEREAAPNEELVQRNRLICRRNPYRIFEYLQLSLEEAFFLVYALGCLSIYYEKEPLTIVKLWKAFTVVQPTFRTTYMAYHYFRSKGWVPKVGLKYGTDLLLYRKGPPFYHA

SEQ ID NO: 68280 - protein, 438 aa, Homo sapiens
MAEAVFHAPKRKRRVYETYESPLPIPFGQDHGPLKEFKIFRAEMINNNVIVRNAEDIEQLYGKDMKTNMPIITSKRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDHEYVLVEEAECAMSEREAAPNEELVQRNRLICRRNPYRIFEYLQLSLEEAFFLVYALGCLSIYYEKEPLTIVKLWKAFTVVQPTFRTTYMAYHYFRSKGWVPKVGLKYGTDLLLYRKGPPFYHASYSVIIELVDDHFEGSLRRPLSWKSLAALSRVSVNVSKELMLCYLIKPSTMTDKEMESPECMKRIKVQEVILSRWVSSRERSDQDDL

SEQ ID NO: 68281 - protein, 406 aa, Homo sapiens
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVRGLHHEDGSQHIGLLHPGDRGPDHEYVLVEEAECAMSEREAAPNEELVQRNRLICRRNPYRIFEYLQLSLEEAFFLVYALGCLSIYYEKEPLTIVKLWKAFTVVQPTFRTTYMAYHYFRSKGWVPKVGLKYGTDLLLYRKGPPFYHASYSVIIELVDDHFEGSLRRPLSWKSLAALSRVSVNVSKELMLCYLIKPSTMTDKEMESPECMKRIKVQEVILSRWVSSRERSDQDDL

SEQ ID NO: 68282 - protein, 310 aa, Homo sapiens
MLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGGDFLVYPGDPLRFHAHYIAQCWAPEDTIPLQDLVAAGRLGTSVRKTLLLCSPQPDGKVVYTSLQWASLQ

SEQ ID NO: 68283 - protein, 310 aa, Homo sapiens; identical to SEQ ID NO: 68282

SEQ ID NO: 68284 - protein, 310 aa, Homo sapiens; identical to SEQ ID NO: 68282

SEQ ID NO: 68285 - protein, 312 aa, Homo sapiens
MLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGGDFLVYPGDPLRFHAHYIAQCWAPEDTIPLQDLVAAGRLGTSVRKTLLLCSPQPDGFKSQEVSINLVYKCS

SEQ ID NO: 68286 - protein, 242 aa, Homo sapiens
MLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGG

SEQ ID NO: 68287 - protein, 526 aa, Homo sapiens
MEPEPEPAAVEVPAGRVLSARELFAARSRSQKLPQRSHGPKDFLPDGSAAQAERLRRCREELWQLLAEQRVERLGSLVAAEWRPEEGFVELKSPAGKFWQTMGFSEQGRQRLHPEEALYLLECGSIHLFHQDLPLSIQEAYQLLLTDHTVTFLQYQVFSHLKRLGYVVRRFQPSSVLSPYERQLNLDASVQHLEDGDGKRKRSSSSPRSINKKAKALDNSLQPKSLAASSPPPCSQPSQCPEEKPQESSPMKGPGGPFQLLGSLGPSPGPAREGVGCSWESGRAENGVTGAGKRRWNFEQISFPNMASDSRHTLLRAPAPELLPANVAGRETDAESWCQKLNQRKEKLSRREREHHAEAAQFQEDVNADPEVQRCSSWREYKELLQRRQVQRSQRRAPHLWGQPVTPLLSPGQASSPAVVLQHISVLQTTHLPDGGARLLEKSGGLEIIFDVYQADAVATFRKNNPGKPYARMCISGFDEPVPDLCSLKRLSYQSGDVPLIFALVDHGDISFYSFRDFTLPQDVGH

SEQ ID NO: 68288 - protein, 197 aa, Homo sapiens
MGFSEQGRQRLHPEEALYLLECGSIHLFHQDLPLSIQEAYQLLLTDHTVTFLQYQVFSHLKRLGYVVRRFQPSSVLSPYERQLNLDASVQHLEDGDGKRKRSSSSPRSINKKAKALDNSLQPKSLAASSPPSGTSRCPRMWGTDLTALQRMELAPGDRDCLFSGTISAASCTQTLTCSFRGQSGPWPWVSDTHRVKL

SEQ ID NO: 68289 - protein, 177 aa, Homo sapiens
MEPEPEPAAVEVPAGRVLSARELFAARSRSQKLPQRSHGPKDFLPDGSAAQAERLRRCREELWQLLAEQRVERLGSLVAAEWRPEEGFVELKSPAGKFWQTMGFSEQGRQRLHPEEALYLLECGSIHLFHQDLPLSIQEAYQLLLTDHTVTFLQYQPPEEVGLCGSTIPTKLCPVPV

SEQ ID NO: 68290 - protein, 1431 aa, Homo sapiens
MDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEHIEALNVTDAATRQIEASVVAIRPKKSKGKKAASRGPNSVSEISEAPLATQIVTNQALAATLRVKRGSRARKAATKARATESQTPNADQGAQAKIASAQTNVSALETQVAAAVQALADDYLAQLSLEPTTRTRGKRNRKSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEARAQMGIGEEAVAGPWNWDDMDIDCLTREELGDDAQAWSRFSFEIEARAQENADASTNVNFSRGASTRAGFSDGASISFNGAPSSSGGFSGGPGITFGVAPSTSASFSNTASISFGGTLSTSSSFSSAASISFGCAHSTSTSFSSEASISFGGMPCTSASFSGGVSSSFSGPLSTSATFSGGASSGFGGTLSTTAGFSGVLSTSTSFGSAPTTSTVFSSALSTSTGFGGILSTSVCFGGSPSSSGSFGGTLSTSICFGGSPCTSTGFGGTLSTSVSFGGSSSTSANFGGTLSTSICFDGSPSTGAGFGGALNTSASFGSVLNTSTGFGGAMSTSADFGGTLSTSVCFGGSPGTSVSFGSALNTNAGYGGAVSTNTDFGGTLSTSVCFGGSPSTSAGFGGALNTNASFGCAVSTSASFSGAVSTSACFSGAPITNPGFGGAFSTSAGFGGALSTAADFGGTPSNSIGFGAAPSTSVSFGGAHGTSLCFGGAPSTSLCFGSASNTNLCFGGPPSTSACFSGATSPSFCDGPSTSTGFSFGNGLSTNAGFGGGLNTSAGFGGGLGTSAGFSGGLSTSSGFDGGLGTSAGFGGGPGTSTGFGGGLGTSAGFSGGLGTSAGFGGGLVTSDGFGGGLGTNASFGSTLGTSAGFSGGLSTSDGFGSRPNASFDRGLSTIIGFGSGSNTSTGFTGEPSTSTGFSSGPSSIVGFSGGPSTGVGFCSGPSTSGFSGGPSTGAGFGGGPNTGAGFGGGPSTSAGFGSGAASLGACGFSYG

SEQ ID NO: 68291 - protein, 706 aa, Homo sapiens
MDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEHIEALNVTDAATRQIEASVVAIRPKKSKGKKAASRGPNSVSEISEAPLATQIVTNQALAATLRVKRGSRARKAATKARATESQTPNADQGAQAKIASAQTNVSALETQVAAAVQALADDYLAQLSLEPTTRTRGKRNRKSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEIYSPCLQIPLINCSSPSHGAKVHPWNLCPHSSQGSYGQSAEGVM

SEQ ID NO: 68292 - protein, 357 aa, Homo sapiens
MDRRNDYGYRVPLFQSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQLQLWLWLRLKPGLSGSNTSTGFTGEPSTSTGFSSGPSSIVGFSGGPSTGVGFCSGPSTSGFSGGPSTGAGFGGGPNTGAGFGGGPSTSAGFGSGAASLGACGFSYG

SEQ ID NO: 68293 - protein, 706 aa, Homo sapiens; identical to SEQ ID NO: 68291

SEQ ID NO: 68294 - protein, 1034 aa, Homo sapiens
MDRRNDYGYRVPLFQSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEARAQMGIGEEAVAGPWNWDDMDIDCLTREELGDDAQAWSRFSFEIEARAQENADASTNVNFSRGASTRAGFSDGASISFNGAPSSSGGFSGGPGITFGVAPSTSASFSNTASISFGGTLSTSSSFSSAASISFGCAHSTSTSFSSEASISFGGMPCTSASFSGGVSSSFSGPLSTSATFSGGASSGFGGTLSTTAGFSGVLSTSTSFGSAPTTSTVFSSALSTSTGFGGILSTSVCFGGSPSSSGSFGGTLSTSICFGGSPCTSTGFGGTLSTSVSFGGSSSTSANFGGTLSTSICFDGSPSTGAGFGGALNTSASFGSVLNTSTGFGGAMSTSADFGGTLSTSVCFGGSPGTSVSFGSALNTNAGYGGAVSTNTDFGGTLSTSVCFGGSPSTSAGFGGALNTNASFGCAVSTSASFSGAVSTSACFSGAPITNPGFGGAFSTSAGFGGALSTAADFGGTPSNSIGFGAAPSTSVSFGGAHGTSLCFGGAPSTSLCFGSASNTNLCFGGPPSTSACFSGATSPSFCDGPSTSTGFSFGNGLSTNAGFGGGLNTSAGFGGGLGTSAGFSGGLSTSSGFDGGLGTSAGFGGGPGTSTGFGGGLGTSAGFSGGLGTSAGFGGGLVTSDGFGGGLGTNASFGSTLGTSAGFSGGLSTSDGFGSRPNASFDRGLSTIIGFGSGSNTSTGFTGEPSTSTGFSSGPSSIVGFSGGPSTGVGFCSGPSTSGFSGGPSTGAGFGGGPNTGAGFGGGPSTSAGFGSGAASLGACGFSYG

SEQ ID NO: 68295 - protein, 230 aa, Homo sapiens
MHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEH

SEQ ID NO: 68296 - protein, 169 aa, Homo sapiens
MDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSP

SEQ ID NO: 68297 - protein, 962 aa, Homo sapiens
MLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEARAQMGIGEEAVAGPWNWDDMDIDCLTREELGDDAQAWSRFSFEIEARAQENADASTNVNFSRGASTRAGFSDGASISFNGAPSSSGGFSGGPGITFGVAPSTSASFSNTASISFGGTLSTSSSFSSAASISFGCAHSTSTSFSSEASISFGGMPCTSASFSGGVSSSFSGPLSTSATFSGGASSGFGGTLSTTAGFSGVLSTSTSFGSAPTTSTVFSSALSTSTGFGGILSTSVCFGGSPSSSGSFGGTLSTSICFGGSPCTSTGFGGTLSTSVSFGGSSSTSANFGGTLSTSICFDGSPSTGAGFGGALNTSASFGSVLNTSTGFGGAMSTSADFGGTLSTSVCFGGSPGTSVSFGSALNTNAGYGGAVSTNTDFGGTLSTSVCFGGSPSTSAGFGGALNTNASFGCAVSTSASFSGAVSTSACFSGAPITNPGFGGAFSTSAGFGGALSTAADFGGTPSNSIGFGAAPSTSVSFGGAHGTSLCFGGAPSTSLCFGSASNTNLCFGGPPSTSACFSGATSPSFCDGPSTSTGFSFGNGLSTNAGFGGGLNTSAGFGGGLGTSAGFSGGLSTSSGFDGGLGTSAGFGGGPGTSTGFGGGLGTSAGFSGGLGTSAGFGGGLVTSDGFGGGLGTNASFGSTLGTSAGFSGGLSTSDGFGSRPNASFDRGLSTIIGFGSGSNTSTGFTGEPSTSTGFSSGPSSIVGFSGGPSTGVGFCSGPSTSGFSGGPSTGAGFGGGPNTGAGFGGGPSTSAGFGSGAASLGACGFSYG

SEQ ID NO: 68298 - protein, 121 aa, Homo sapiens
MHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQ

SEQ ID NO: 68299 - protein, 192 aa, Homo sapiens
MHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQG

SEQ ID NO: 68300 - protein, 176 aa, Homo sapiens
MDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLP

SEQ ID NO: 68301 - protein, 168 aa, Homo sapiens
MDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKS

SEQ ID NO: 68302 - protein, 681 aa, Homo sapiens
MDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEHIEALNVTDAATRQIEASVVAIRPKKSKGKKAASRGPNSVSEISEAPLATQIVTNQALAATLRVKRGSRARKAATKARATESQTPNADQGAQAKIASAQTNVSALETQVAAAVQALADDYLAQLSLEPTTRTRGKRNRKSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEWFQHQHWLYWRTQHQHGLQ

SEQ ID NO: 68303 - protein, 123 aa, Homo sapiens
MHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLK

SEQ ID NO: 68304 - protein, 71 aa, Homo sapiens
MHTLLAATKDSLAMDPPVVNRPKKSKTKKAPIKTITKAAPAAPPVPAANEIATNKPKITWQALNLPVITQI

SEQ ID NO: 68305 - protein, 64 aa, Homo sapiens
MHTLLAATKDSLAMDPPVVNRPKKSKTKKAPIKTITKAAPAAPPVPAANEIATNKPKITWQALN

SEQ ID NO: 68306 - protein, 309 aa, Homo sapiens
MDRRNDYGYRVPLFQSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEIYSPCLQIPLINCSSPSHGAKVHPWNLCPHSSQGSYGQSAEGVM

SEQ ID NO: 68307 - protein, 420 aa, Homo sapiens
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLAVLPAGAFARRPPLAELAALNLSGSRLDEVRAGAFEHLPSLRQLDLSHNPLADLSPFAFSGSNASVSAPSPLVELILNHIVPPEDERQNRSFEGMVVAALLAGRALQGLRRLELASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTSYVFLGIVLALIGAIFLLVLYLNRKGIKKWMHNIRDACRDHMEGYHYRYEINADPRLTNLSSNSDV

SEQ ID NO: 68308 - protein, 420 aa, Homo sapiens; identical to SEQ ID NO: 68307

SEQ ID NO: 68309 - protein, 420 aa, Homo sapiens; identical to SEQ ID NO: 68307

SEQ ID NO: 68310 - protein, 351 aa, Homo sapiens
MALPFQKELEKYKNIDEDELLGKLSEEELKQLENVLDDLDPESAMLPAGFRQKDQTQKAATGPFDREHLLMYLEKEALEQKDREDFVPFTGEKKGRVFIPKEKPIETRKEEKVTLDPELEEALASASDTELYDLAAVLGVHNLLNNPKFDEETANNKGGKGPVRNVVKGEKVKPVFEEPPNPTNVEISLQQMKANDPSLQEVNLNNIKNIPIPTLREFAKALETNTHVKKFSLAATRSNDPVAIAFADMLKVNKTLTSLNIESNFITGTGILALVEALKENDTLTEIKIDNQRQQLGTAVEMEIAQMLEENSRILKFGYQFTKQGPRTRVAAAITKNNDLVRKKRVEADRR

SEQ ID NO: 68311 - protein, 315 aa, Homo sapiens
MALPFQKELEKYKNIDEDELLGKLSEEELKQLENVLDDLDPESAMLPAGFRQKDQTQKAATGPFDREHLLMYLEKEALEQKDREDFVPFTGEKKGRVFIPKEKPIETRKEEKVTLDPELEEALASASDTELYDLAAVLGVHNLLNNPKFDEETANNKGGKGPVRNVVKGEKVKPVFEEPPNPTNVEISLQQMKANDPSLQEVNLNNIKAFADMLKVNKTLTSLNIESNFITGTGILALVEALKENDTLTEIKIDNQRQQLGTAVEMEIAQMLEENSRILKFGYQFTKQGPRTRVAAAITKNNDLVRKKRVEADRR

SEQ ID NO: 68312 - protein, 352 aa, Homo sapiens
MALPFRKDLEKYKDLDEDELLGNLSETELKQLETVLDDLDPENALLPAGFRQKNQTSKSTTGPFDREHLLSYLEKEALEHKDREDYVPYTGEKKGKIFIPKQKPVQTFTEEKVSLDPELEEALTSASDTELCDLAAILGMHNLITNTKFCNIMGSSNGVDQEHFSNVVKGEKILPVFDEPPNPTNVEESLKRTKENDAHLVEVNLNNIKNIPIPTLKDFAKALETNTHVKCFSLAATRSNDPVATAFAEMLKVNKTLKSLNVESNFITGVGILALIDALRDNETLAELKIDNQRQQLGTAVELEMAKMLEENTNILKFGYQFTQQGPRTRAANAITKNNDLVRKRRVEGDHQ

SEQ ID NO: 68313 - protein, 352 aa, Homo sapiens; identical to SEQ ID NO: 68312

SEQ ID NO: 68314 - protein, 33 aa, Homo sapiens
MALPFRKDLEKYKDLDEDELLGNLSETELKQLE

SEQ ID NO: 68315 - protein, 345 aa, Homo sapiens
MSSYQKELEKYRDIDEDEILRTLSPEELEQLDCELQEMDPENMLLPAGLRQRDQTKKSPTGPLDREALLQYLEQQALEVKERDDLVPFTGEKKGKPYIQPKREIPAEEQITLEPELEEALAHATDAEMCDIAAILDMYTLMSNKQYYDALCSGEICNTEGISSVVQPDKYKPVPDEPPNPTNIEEILKRVRSNDKELEEVNLNNIQDIPIPMLSELCEAMKANTYVRSFSLVATRSGDPIANAVADMLRENRSLQSLNIESNFISSTGLMAVLKAVRENATLTELRVDNQRQWPGDAVEMEMATVLEQCPSIVRFGYHFTQQGPRARAAQAMTRNNELRRQQKKR

SEQ ID NO: 68316 - protein, 276 aa, Homo sapiens
MSSYQKELEKYRDIDEDEILRTLSPEELEQLDCELQEMDPENMLLPAGLRQRDQTKKSPTGPLDREALLQYLEQQALEVKERDDLVPFTGEKKGVVQPDKYKPVPDEPPNPTNIEEILKRVRSNDKELEEVNLNNIQDIPIPMLSELCEAMKANTYVRSFSLVATRSGDPIANAVADMLRENRSLQSLNIESNFISSTGLMAVLKAVRENATLTELRVDNQRQWPGDAVEMEMATVLEQCPSIVRFGYHFTQQGPRARAAQAMTRNNELRRQQKKR

SEQ ID NO: 68317 - protein, 142 aa, Homo sapiens
MSSYQKELEKYRDIDEDEILRTLSPEELEQLDCELQEMDPENMLLPAGLRQRDQTKKSPTGPLDREALLQYLEQQALEVKERDDLVPFTGEKKGKPYIQPKREIPAEEQITLEPELEEALAHATDAEMCDIAAILDMYTLMS

SEQ ID NO: 68318 - protein, 284 aa, Homo sapiens
MDAIKKKMQMLKLDKENALDRAEQAEADKKAAEDRSKQLEEDIAAKEKLLRVSEDERDRVLEELHKAEDSLLAAEEAAAKAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEEKVAHAKEENLSMHQMLDQTLLELNNM

SEQ ID NO: 68319 - protein, 284 aa, Homo sapiens
MDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQVRQLEEQLRIMDQTLKALMAAEDKYSQKEDRYEEEIKVLSDKLKEAETRAEFAERSVTKLEKSIDDLEDELYAQKLKYKAISEELDHALNDMTSM

SEQ ID NO: 68320 - protein, 245 aa, Homo sapiens
MAGSSSLEAVRRKIRSLQEQADAAEERAGTLQRELDHERKLRETAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEDQLYQQLEQNRRLTNELKLALNED

SEQ ID NO: 68321 - protein, 326 aa, Homo sapiens
MDAIKKKMQMLKLDKENALDRAEQAEADKKAAEDRSKQLEEDIAAKEKLLRVSEDERDRVLEELHKAEDSLLAAEEAAAKLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEEKVAHAKEENLSMHQMLDQTLLELNNM

SEQ ID NO: 68322 - protein, 284 aa, Homo sapiens
MDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQVRQLEEQLRIMDQTLKALMAAEDKYSQKEDRYEEEIKVLSDKLKEAETRAEFAERSVTKLEKSIDDLEEKVAHAKEENLSMHQMLDQTLLELNNM

SEQ ID NO: 68323 - protein, 284 aa, Homo sapiens
MDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEDELYAQKLKYKAISEELDHALNDMTSI

SEQ ID NO: 68324 - protein, 284 aa, Homo sapiens
MDAIKKKMQMLKLDKENALDRAEQAEADKKAAEDRSKQLEEDIAAKEKLLRVSEDERDRVLEELHKAEDSLLAAEEAAAKAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQVRQLEEQLRIMDQTLKALMAAEDKYSQKEDRYEEEIKVLSDKLKEAETRAEFAERSVTKLEKSIDDLEEKVAHAKEENLSMHQMLDQTLLELNNM

SEQ ID NO: 68325 - protein, 284 aa, Homo sapiens
MDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEEKVAHAKEENLSMHQMLDQTLLELNNM

SEQ ID NO: 68326 - protein, 265 aa, Homo sapiens
  MOD_RES (1)..(1): Any amino acid
XRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEDELYAQKLKYKAISEELDHALNDMTSM

SEQ ID NO: 68327 - protein, 284 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESKCGDLEEELKIVTNNLKSLEAQADKYSTKEDKYEEEIKLLEEKLKEAETRAEFAERSVAKLEKTIDDLEETLASAKEENVEIHQTLDQTLLELNNL

SEQ ID NO: 68328 - protein, 284 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESKCGDLEEELKIVTNNLKSLEAQADKYSTKEDKYEEEIKLLEEKLKEAETRAEFAERSVAKLEKTIDDLEDEVYAQKMKYKAISEELDNALNDITSL

SEQ ID NO: 68329 - protein, 284 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESRARQLEEELRTMDQALKSLMASEEEYSTKEDKYEEEIKLLEEKLKEAETRAEFAERSVAKLEKTIDDLEETLASAKEENVEIHQTLDQTLLELNNL

SEQ ID NO: 68330 - protein, 322 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESKCGDLEEELKIVTNNLKSLEAQADKYSTKEDKYEEEIKLLEEKLKEAETRAEFAERSVAKLEKTIDDLEESTSIATTEHWFTPDTLALTDTPSPCTEPTHKTPWPTLKPLCTGTPWLSLSDSPLHVGTCGPIKP

SEQ ID NO: 68331 - protein, 285 aa, Homo sapiens
MMEAIKKKMQMLKLDKENALDRAEQAEAEQKQAEERSKQLEDELAAMQKKLKGTEDELDKYSEALKDAQEKLELAEKKAADAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 68332 - protein, 247 aa, Homo sapiens
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESKCSELEEELKNVTNNLKSLEAQAEKYSQKEDKYEEEIKILTDKLKEAETRAEFAERSVAKLEKTIDDLEERLYSQLERNRLLSNELKLTLHDLCD

SEQ ID NO: 68333 - protein, 248 aa, Homo sapiens
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDELYAQKLKYKAISEELDHALNDMTSI

SEQ ID NO: 68334 - protein, 248 aa, Homo sapiens
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESKCSELEEELKNVTNNLKSLEAQAEKYSQKEDKYEEEIKILTDKLKEAETRAEFAERSVAKLEKTIDDLEDKLKCTKEEHLCTQRMLDQTLLDLNEM

SEQ ID NO: 68335 - protein, 224 aa, Homo sapiens
MAGITTIEAVKRKIQVLQQQADDAEERAERLQREVEGERRAREQRLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 68336 - protein, 285 aa, Homo sapiens
MMEAIKKKMQMLKLDKENALDRAEQAEAEQKQAEERSKQLEDELAAMQKKLKGTEDELDKYSEALKDAQEKLELAEKKAADAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESKCSELEEELKNVTNNLKSLEAQAEKYSQKEDKYEEEIKILTDKLKEAETRAEFAERSVAKLEKTIDDLEDELYAQKLKYKAISEELDHALNDMTSI

SEQ ID NO: 68337 - protein, 247 aa, Homo sapiens
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEERLYSQLERNRLLSNELKLTLHDLCD

SEQ ID NO: 68338 - protein, 248 aa, Homo sapiens
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 68339 - protein, 75 aa, Homo sapiens
MMEAIKKKMQMLKLDKENALDRAEQAEAEQKQAEERSKQLEDELAAMQKKLKGTEDELDKYSEALKDAQEKLELA

SEQ ID NO: 68340 - protein, 248 aa, Homo sapiens
MAGLNSLEAVKRKIQALQQQADEAEDRAQGLQRELDGERERREKAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEEKLAQAKEENVGLHQTLDQTLNELNCI

SEQ ID NO: 68341 - protein, 284 aa, Homo sapiens
MEAIKKKMQMLKLDKENAIDRAEQAEADKKAAEDKCKQVEEELTHLQKKLKGTEDELDKYSEDLKDAQEKLELTEKKASDAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEEKLAQAKEENVGLHQTLDQTLNELNCI

SEQ ID NO: 68342 - protein, 284 aa, Homo sapiens; identical to SEQ ID NO: 68341

SEQ ID NO: 68343 - protein, 161 aa, Homo sapiens
MDDIYKAAVEQLTEEQKNEFKAAFDIFVLGAEDGCISTKELGKVMRMLGQNPTPEELQEMIDEVDEDGSGTVDFDEFLVMMVRCMKDDSKGKSEEELSDLFRMFDKNADGYIDLDELKIMLQATGETITEDDIEELMKDGDKNNDGRIDYDEFLEFMKGVE

SEQ ID NO: 68344 - protein, 160 aa, Homo sapiens
MTDQQAEARSYLSEEMIAEFKAAFDMFDADGGGDISVKELGTVMRMLGQTPTKEELDAIIEEVDEDGSGTIDFEEFLVMMVRQMKEDAKGKSEEELAECFRIFDRNADGYIDPEELAEIFRASGEHVTDEEIESLMKDGDKNNDGRIDFDEFLKMMEGVQ

SEQ ID NO: 68345 - protein, 145 aa, Homo sapiens
MIAEFKAAFDMFDADGGGDISVKELGTVMRMLGQTPTKEELDAIIEEVDEDGSGTIDFEEFLVMMVRQMKEDAKGKSEEELAECFRIFDRNADGYIDPEELAEIFRASGEHVTDEEIESLMKDGDKNNDGRIDFDEFLKMMEGVQ

SEQ ID NO: 68346 - protein, 187 aa, Homo sapiens
MPEVERKPKITASRKLLLKSLMLAKAKECWEQEHEEREAEKVRYLAERIPTLQTRGLSLSALQDLCRELHAKVEVVDEERYDIEAKCLHNTREIKDLKLKVMDLRGKFKRPPLRRVRVSADAMLRALLGSKHKVSMDLRANLKSVKKEDTEKERPVEVGDWRKNVEAMSGMEGRKKMFDAAKSPTSQ

SEQ ID NO: 68347 - protein, 187 aa, Homo sapiens [sequence omitted]

SEQ ID NO: 68348 - protein, 187 aa, Homo sapiens; identical to SEQ ID NO: 68346

SEQ ID NO: 68349 - protein, 187 aa, Homo sapiens; identical to SEQ ID NO: 68346

SEQ ID NO: 68350 - protein, 187 aa, Homo sapiens [sequence omitted]

SEQ ID NO: 68351 - protein, 137 aa, Homo sapiens
MPEVERKPKITASRKLLLKSLMLAKAKECWEQEHEEREAEKVRYLAERIPTLQTRGLSLSALQDLCRELHAKVEVVDEERYDIEAKCLHNTREIKDLKLKVMDLRGKFKRPPLRRVRVSADAMLRALLGSKHKVSMD

SEQ ID NO: 68352 - protein, 182 aa, Homo sapiens
MSQCKKRNRAITARRQHLKSVMLQIAATELEKEESRREAEKQNYLAEHCPPLHIPGSMSEVQELCKQLHAKIDAAEEEKYDMEVRVQKTSKELEDMNQKLFDLRGKFKRPPLRRVRMSADAMLKALLGSKHKVCMDLRANLKQVKKEDTEKERDLRDVGDWRKNIEEKSGMEGRKKMFESES

SEQ ID NO: 68353 - protein, 182 aa, Homo sapiens
MGDEEKRNRAITARRQHLKSVMLQIAATELEKEESRREAEKQNYLAEHCPPLHIPGSMSEVQELCKQLHAKIDAAEEEKYDMEVRVQKTSKELEDMNQKLFDLRGKFKRPPLRRVRMSADAMLKALLGSKHKVCMDLRANLKQVKKEDTEKERDLRDVGDWRKNIEEKSGMEGRKKMFESES

SEQ ID NO: 68354 - protein, 182 aa, Homo sapiens; identical to SEQ ID NO: 68353

SEQ ID NO: 68355 - protein, 182 aa, Homo sapiens; identical to SEQ ID NO: 68353

SEQ ID NO: 68356 - protein, 210 aa, Homo sapiens
MADGSSDAAREPRPAPAPIRRRSSNYRAYATEPHAKKKSKISASRKLQLKTLLLQIAKQELEREAEERRGEKGRALSTRCQPLELAGLGFAELQDLCRQLHARVDKVDEERYDIEAKVTKNITEIADLTQKIFDLRGKFKRPTLRRVRISADAMMQALLGARAKESLDLRAHLKQVKKEDTEKENREVGDWRKNIDALSGMEGRKKKFES

SEQ ID NO: 68357 - protein, 278 aa, Homo sapiens
MSDTEEQEYEEEQPEEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLRARSAWLPPSQPSCPAREKAQELSDWIHQLESEKFDLMAKLKQQKYEINVLYNRISHAQKFRKGAGKGRVGGRWK

SEQ ID NO: 68358 - protein, 278 aa, Homo sapiens; identical to SEQ ID NO: 68357

SEQ ID NO: 68359 - protein, 251 aa, Homo sapiens
MSDTEEQEYEEEQPEEEAAEEEEEEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLKQQKYEINVLYNRISHAQKFRKGAGKGRVGGRWK

SEQ ID NO: 68360 - protein, 173 aa, Homo sapiens
SKAQPQDSQHLRHSLGRTRMSDTEEQEYEEEQPEEEAAEEEEEGEVPDSAEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKKKKKKK

SEQ ID NO: 68361 - protein, 251 aa, Homo sapiens
MSDTEEQEYEEEQPEEEAAEEEEEAPEEPEPVRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLKQQKYEINVLYNRISHAQKFRKGAGKGRVGGRWK

SEQ ID NO: 68362 - protein, 192 aa, Homo sapiens
MEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLKQQKYEINVLYNRISHAQKFRKGAGKGRVGGRWK

SEQ ID NO: 68363 - protein, 293 aa, Homo sapiens
MSDIEEVVEEYEEEHPEEEEDWREDEDEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQKQAQTERKSGKRQTEREKKKKILAERRKVLAIDHLNEDQLREKAKELWQSIYNLEAEKFDLQEKFKQQKYEINVLRNRINDNQKVSKTRGKAKVTGRWK

SEQ ID NO: 68364 - protein, 199 aa, Homo sapiens
MSDIEEVVEEYEEEMAAPQHQEEAAEEDAEAEAETEETRAEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQKHPPDRAEKWEEAD

SEQ ID NO: 68365 - protein, 283 aa, Homo sapiens
MSDIEEVVEEYEEEAKLEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQKQAQTERKSGKRQTEREKKKKILAERRKVLAIDHLNEDQLREKAKELWQSIYNLEAEKFDLQEKFKQQKYEINVLRNRINDNQKVSKTRGKAKVTGRWK

SEQ ID NO: 68366 - protein, 285 aa, Homo sapiens
MSDIEEVVEEYEEEEQEEAAVEEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQKTERKSGKRQTEREKKKKILAERRKVLAIDHLNEDQLREKAKELWQSIYNLEAEKFDLQEKFKQQKYEINVLRNRINDNQKVSKTRGKAKVTGRWK

SEQ ID NO: 68367 - protein, 288 aa, Homo sapiens
MSDIEEVVEEYEEEEQEEAAVEEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQKQAQTERKSGKRQTEREKKKKILAERRKVLAIDHLNEDQLREKAKELWQSIYNLEAEKFDLQEKFKQQKYEINVLRNRINDNQKVSKTRGKAKVTGRWK

SEQ ID NO: 68368 - protein, 288 aa, Homo sapiens; identical to SEQ ID NO: 68367

SEQ ID NO: 68369 - protein, 226 aa, Homo sapiens
MEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQKTERKSGKRQTEREKKKKILAERRKVLAIDHLNEDQLREKAKELWQSIYNLEAEKFDLQEKFKQQKYEINVLRNRINDNQKVSKTRGKAKVTGRWK

SEQ ID NO: 68370 - protein, 285 aa, Homo sapiens; identical to SEQ ID NO: 68366

SEQ ID NO: 68371 - protein, 291 aa, Homo sapiens [sequence omitted]

SEQ ID NO: 68372 - protein, 297 aa, Homo sapiens
MSDIEEVVEEYEEEYLEHAEAAVEEEEDWREDEDEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQKTERKSGKRQTEREKKKKILAERRKVLAIDHLNEDQLREKAKELWQSIYNLEAEKFDLQEKFKQQKYEINVLRNRINDNQKVSKTRGKAKVTGRWK

SEQ ID NO: 68373 - protein, 288 aa, Homo sapiens; identical to SEQ ID NO: 68367

SEQ ID NO: 68374 - protein, 256 aa, Homo sapiens
MSDEEVEQVEEQYEEEEEAQEEAAEVHEEVHEPEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 68375 - protein, 258 aa, Homo sapiens
MSDEEVEQVEEQYEEEEEAQEEEEVQEDTAEEDAEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 68376 - protein, 245 aa, Homo sapiens
MSDEEVEQVEEQYEEEEEAQEEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 68377 - protein, 252 aa, Homo sapiens
MSDEEVEQVEEQYEEEEEAQEEAAEVHEEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDIMNVRARVQMLAKFSKKAGTPAKGKVGGRWK

SEQ ID NO: 68378 - protein, 260 aa, Homo sapiens
MSDEEVEQVEEQYEEEEEAQEEAAEVHEEDTAEEDAEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 68379 - protein, 250 aa, Homo sapiens
MSDEEVEQVEEQYEEEEEAQEEEEVQEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 68380 - protein, 261 aa, Homo sapiens
MSDEEVEQVEEQYEEEEEAQEEAAEVHEEGMRTQDFFHEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 68381 - protein, 261 aa, Homo sapiens
MSDEEVEQVEEQYEEEEEAQEEAAEVHEEVHEPEEVQEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 68382 - protein, 250 aa, Homo sapiens
MSDEEVEQVEEQYEEEEEAQEEEEVQEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDIMNVRARVQMLAKFSKKAGTPAKGKVGGRWK

SEQ ID NO: 68383 - protein, 269 aa, Homo sapiens
MSDEEVEQVEEQYEEEEEAQEEAAEVHEEVHEPEEVQEDTAEEDAEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 68384 - protein, 270 aa, Homo sapiens
MSDEEVEQVEEQYEEEEEAQEEAAEVHEEAHPGEESVREDTAEEDAEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 68385 - protein, 144 aa, Homo sapiens
MSDEEVEQVEEQYEEEEEAQEEAAEVHEEERRAEDDLKKKKALSSMGANYSSYLAKADQKRGKKQTAREMKKKILAERRKPLNIDHLGEDKLRDKAKELWEPPQSCQGLPDSPGGGEAIPGRPPRLCPCCLHPLGPVNKAAEPP

SEQ ID NO: 68386 - protein, 538 aa, Homo sapiens
MEESVNQMQPLNEKQIANSQDGYVWQVTDMNRLHRFLCFGSEGGTYYIKEQKLGLENAEALIRLIEDGRGCEVIQEIKSFSQEGRTTKQEPMLFALAICSQCSDISTKQAAFKAVSEVCRIPTHLFTFIQFKKDLKESMKCGMWGRALRKAIADWYNEKGGMALALAVTKYKQRNGWSHKDLLRLSHLKPSSEGLAIVTKYITKGWKEVHELYKEKALSVETEKLLKYLEAVEKVKRTRDELEVIHLIEEHRLVREHLLTNHLKSKEVWKALLQEMPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRGMLDMCGFDTGALDVIRNFTLDMI

SEQ ID NO: 68387 - protein, 518 aa, Homo sapiens
MEESVNQMQPLNEKQIANSQDGYVWQVTDMNRLHRFLCFGSEGGTYYIKEQKLGLENAEALIRLIEDGRGCEVIQEIKSFSQEGRTTKQEPMLFALAICSQCSDISTKQAAFKAVSEVCRIPTHLFTFIQFKKDLKESMKCGMWGRALRKAIADWYNEKGGMALALAVTKYKQRNGWSHKDLLRLSHLKPSSEGLAIVTKYITKGWKEVHELYKEKALSVETEKLLKYLEAVEKVKRTRDELEVIHLIEEHRLVREHLLTNHLKSKEVWKALLQEMPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRDTVK

SEQ ID NO: 68388 - protein, 525 aa, Homo sapiens
MEESVNQMQPLNEKQIANSQDGYVWQVTDMNRLHRFLCFGSEGGTYYIKEQKLGLENAEALIRLIEDGRGCEVIQEIKSFSQEGRTTKQEPMLFALAICSQCSDISTKQAAFKAVSEVCRIPTHLFTFIQFKKDLKESMKCGMWGRALRKAIADWYNEKGGMALALAVTKYKQRNGWSHKDLLRLSHLKPSSEGLAIVTKYITKGWKEVHELYKEKALSVETEKLLKYLEAVEKVKRTRDELEVIHLIEEHRLVREHLLTNHLKSKEVWKALLQEMPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRALQNTLLNKSF

SEQ ID NO: 68389 - protein, 534 aa, Homo sapiens
MEESVNQMQPLNEKQIANSQDGYVWQVTDMNRLHRFLCFGSEGGTYYIKEQKLGLENAEALIRLIEDGRGCEVIQEIKSFSQEGRTTKQEPMLFALAICSQCSDISTKQAAFKAVSEVCRIPTHLFTFIQFKKDLKESMKCGMWGRALRKAIADWYNEKGGMALALAVTKYKQRNGWSHKDLLRLSHLKPSSEGLAIVTKYITKGWKEVHELYKEKALSVETEKLLKYLEAVEKVKRTRDELEVIHLIEEHRLVREHLLTNHLKSKEVWKALLQEMPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRGMLDMCGFDTGALDPCKIPY

SEQ ID NO: 68390 - protein, 538 aa, Homo sapiens; identical to SEQ ID NO: 68386

SEQ ID NO: 68391 - protein, 538 aa, Homo sapiens; identical to SEQ ID NO: 68386

SEQ ID NO: 68392 - protein, 263 aa, Homo sapiens
MPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRGMLDMCGFDTGALDVIRNFTLDMI

SEQ ID NO: 68393 - protein, 41 aa, Homo sapiens
MEESVNQMQPLNEKQIANSQDGYVWQVTDMNRLHRFLCFGS

SEQ ID NO: 68394 - protein, 349 aa, Homo sapiens
MAASEAAVVSSPSLKTDTSPVLETAGTVAAMAATPSARAAAAVVAAAARTGSEARVSKAALATKLLSLSGVFAVHKPKGPTSAELLNRLKEKLLAEAGMPSPEWTKRKKQTLKIGHGGTLDSAARGVLVVGIGSGTKMLTSMLSGSKRYTAIGELGKATDTLDSTGRVTEEKPYDKITQEDIEGILQKFTGNIMQVPPLYSALKKDGQRLSTLMKRGEVVEAKPARPVTVYSISLQKFQPPFFTLDVECGGGFYIRSLVSDIGKELSSCANVLELTRTKQGPFTLEEHALPEDKWTIDDIAQSLEHCSSLFPAELALKKSKPESNEQVLSCEYITLNEPKREDDVIKTC

SEQ ID NO: 68395 - protein, 331 aa, Homo sapiens
MGSAGLSRLHGLFAVYKPPGLKWKHLRDTVELQLLKGLNARKPPAPKQRVRFLLGPMEGSEEKELTLTATSVPSFINHPLVCGPAFAHLKVGVGHRLDAQASGVLVLGVGHGCRLLTDMYNAHLTKDYTVRGLLGKATDDFREDGRLVEKTTYDHVTREKLDRILAVIQGSHQKALVMYSNLDLKTQEAYEMAVRGLIRPMNKSPMLITGIRCLYFAPPEFLLEVQCMHETQKELRKLVHEIGLELKTTAVCTQVRRTRDGFFTLDSALLRTQWDLTNIQDAIRAATPQVAAELEKSLSPGLDTKQLPSPGWSWDSQGPSSTLGLERGAGQ

SEQ ID NO: 68396 - protein, 275 aa, Homo sapiens
MEGSEEKELTLTATSVPSFINHPLVCGPAFAHLKVGVGHRLDAQASGVLVLGVGHGCRLLTDMYNAHLTKDYTVRGLLGKATDDFREDGRLVEKTTYDHVTREKLDRILAVIQGSHQKALVMYSNLDLKTQEAYEMAVRGLIRPMNKSPMLITGIRCLYFAPPEFLLEVQCMHETQKELRKLVHEIGLELKTTAVCTQVRRTRDGFFTLDSALLRTQWDLTNIQDAIRAATPQVAAELEKSLSPGLDTKQLPSPGWSWDSQGPSSTLGLERGAGQ

SEQ ID NO: 68397 - protein, 566 aa, Homo sapiens
MRRQWGSAMRAAEQAGCMVSASRAGQPEAGPWSCSGVILSRSPGLVLCHGGIFVPFLRAGSEVLTAAGAVFLPGDSCRDDLRLHVQWAPTAAGPGGGAERGRPGLCTPQCASLEPGPPAPSRGRPLQPRLPAELLLLLSCPAFWAHFARLFGDEAAEQWRFSSAARDDEVSEDEEADQLRALGWFALLGVRLGQEEVEEERGPAMAVSPLGAVPKGAPLLVCGSPFGAFCPDIFLNTLSCGVLSNVAGPLLLTDARCLPGTEGGGVFTARPAGALVALVVAPLCWKAGEWVGFTLLCAAAPLFRAARDALHRLPHSTAALAALLPPEVGVPWGLPLRDSGPLWAAAAVLVECGTVWGSGVAVAPRLVVTCRHVSPREAARVLVRSTTPKSVAIWGRVVFATQETCPYDIAVVSLEEDLDDVPIPVPAEHFHEGEAVSVVGFGVFGQSCGPSVTSGILSAVVQVNGTPVMLQTTCAVHSGSSGGPLFSNHSGNLLGIITSNTRDNNTGATYPHLNFSIPITVLQPALQQYSQTQDLGGLRELDRAAEPVRVVWRLQRPLAEAPRSKL

SEQ ID NO: 68398 - protein, 398 aa, Homo sapiens
MRRQWGSAMRAAEQAGCMVSASRAGQPEAGPWSCSGVILSRSPGLVLCHGGIFVPFLRAGSEVLTAAGAVFLPGDSCRDDLRLHVQWAPTAAGPGGGAERGRPGLCTPQCASLEPGPPAPSRGRPLQPRLPAELLLLLSCPAFWAHFARLFGDEAAEQWRFSSAARDDEVSEDEEADQLRALGWFALLGVRLGQEEVEEERGPAMAVSPLGAVPKGAPLLVCGSPFGAFCPDIFLNTLSCGVLSNVAGPLLLTDARCLPGTEGGGVFTARPAGALVALVVAPLCWKAGEWVGFTLLCAAAPLFRAARDALHRLPHSTAALAALLPPEVGVPWGLPLRDSGPLWAAAAVLVECGTVWGSGVAVAPRLVVTCRHVSPREAARVLVRSTTPKHNHQQHPGQ

SEQ ID NO: 68399 - protein, 275 aa, Homo sapiens
MLNLLLLALPVLASRAYAAPAPGQALQRVGIVGGQEAPRSKWPWQVSLRVHGPYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 68400 - protein, 282 aa, Homo sapiens
MLLLAPQMLNLLLLALPVLASRAYAAPAPGQALQRVGIVGGQEAPRSKWPWQVSLRVHGPYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 68401 - protein, 242 aa, Homo sapiens
MLLLAPQMLSLLLLALPVLASPAYVAPAPGQALQQTGIVGGQEAPRSKWPWQVSLRVRGPYWMHFCGGSLIHPQWVLTAAHCVEPDIKDLAALRVQLREQHLYYQDQLLPVSRIIVHPQFYIIQTGADIALLELEEPVNISSHIHTVTLPPASETFPPGMPCWVTGWGDVDNNVHLPPPYPLKEVEVPVVENHLCNAEYHTGLHTGHSFQIVRDDMLCAGSENHDSCQGDSGGPLVCKVNGT

SEQ ID NO: 68402 - protein, 235 aa, Homo sapiens
MLSLLLLALPVLASPAYVAPAPGQALQQTGIVGGQEAPRSKWPWQVSLRVRGPYWMHFCGGSLIHPQWVLTAAHCVEPDIKDLAALRVQLREQHLYYQDQLLPVSRIIVHPQFYIIQTGADIALLELEEPVNISSHIHTVTLPPASETFPPGMPCWVTGWGDVDNNVHLPPPYPLKEVEVPVVENHLCNAEYHTGLHTGHSFQIVRDDMLCAGSENHDSCQGDSGGPLVCKVNGT

SEQ ID NO: 68403 - protein, 321 aa, Homo sapiens
MALGACGLLLLLAVPGVSLRTLQPGCGRPQVSDAGGRIVGGHAAPAGAWPWQASLRLRRVHVCGGSLLSPQWVLTAAHCFSGSLNSSDYQVHLGELEITLSPHFSTVRQIILHSSPSGQPGTSGDIALVELSVPVTLSSRILPVCLPEASDDFCPGIRCWVTGWGYTREGEPLPPPYSLREVKVSVVDTETCRRDYPGPGGSILQPDMLCARGPGDACQDDSGGPLVCQVNGAWVQAGTVSWGEGCGRPNRPGVYTRVPAYVNWIRRHITASGGSESGYPRLPLLAGFFLPGLFLLLVSCVLLAKCLLHPSADGTPFPAPD

SEQ ID NO: 68404 - protein, 406 aa, Homo sapiens
MSGCPFLGNNFGYTFKKLPVEGSEEDKSQTGVNRASKGGLIYGNYLHLEKVLNAQELQSETKGNKIHDEHLFIITHQAYELWFKQILWELDSVREIFQNGHVRDERNMLKVVSRMHRVSVILKLLVQQFSILETMTALDFNDFREYLSPASGFQSLQFRLLENKIGVLQNMRVPYNRRHYRDNFKGEENELLLKSEQEKTLLELVEAWLERTPGLEPHGFNFWGKLEKNITRGLEEEFIRIQAKEESEEKEEQVAEFQKQKEVLLSLFDEKRHEHLLSKGERRLSYRALQGALMIYFYREEPRFQVPFQLLTSLMDIDSLMTKWRYNHVCMVHRMLGSKAGTGGSSGYHYLRSTVSDRYKVFVDLFNLSTYLIPRHWIPKMNPTIHKFLYTAEYCDSSYFSSDESD

SEQ ID NO: 68405 - protein, 444 aa, Homo sapiens
MIEDNKENKDHSLERGRASLIFSLKNEVGGLIKALKIFQEKHVNLLHIESRKSKRRNSEFEIFVDCDINREQLNDIFHLLKSHTNVLSVNLPDNFTLKEDGMETVPWFPKKISDLDHCANRVLMYGSELDADHPGFKDNVYRKRRKYFADLAMNYKHGDPIPKVEFTEEEIKTWGTVFQELNKLYPTHACREYLKNLPLLSKYCGYREDNIPQLEDVSNFLKERTGFSIRPVAGYLSPRDFLSGLAFRVFHCTQYVRHSSDPFYTPEPDTCHELLGHVPLLAEPSFAQFSQEIGLASLGASEEAVQKLATCYFFTVEFGLCKQDGQLRVFGAGLLSSISELKHALSGHAKVKPFDPKITCKQECLITTFQDVYFVSESFEDAKEKMREFTKTIKRPFGVKYNPYTRSIQILKDTKSITSAMNELQHDLDVVSDALAKVSRKPSI

SEQ ID NO: 68406 - protein, 466 aa, Homo sapiens
MIEDNKENKDHSLERGRASLIFSLKNEVGGLIKALKIFQEKHVNLLHIESRKSKRRNSEFEIFVDCDINREQLNDIFHLLKSHTNVLSVNLPDNFTLKEDGMETVPWFPKKISDLDHCANRVLMYGSELDADHPGFKDNVYRKRRKYFADLAMNYKHGDPIPKVEFTEEEIKTWGTVFQELNKLYPTHACREYLKNLPLLSKYCGYREDNIPQLEDVSNFLKERTGFSIRPVAGYLSPRDFLSGLAFRVFHCTQYVRHSSDPFYTPEPDTCHELLGHVPLLAEPSFAQFSQEIGLASLGASEEAVQKLATCYFFTVEFGLCKQDGQLRVFGAGLLSSISELKHALSGHAKVKPFDPKITCKQECLITTFQDVYFVSESFEDAKEKMREFTKTIKRPFGVKYNPYTRSIQILKDTKSITSAMNELQHDLDVVSDALAKSLNEDVLQVSVFALLLFLPSLHGECHPDT

SEQ ID NO: 68407 - protein, 250 aa, Homo sapiens
MQPAMMMFSSKYWARRGFSLDSAVPEEHQLLGSSTLNKPNSGKNDDKGNKGSSKREAATESGKTAVVFSLKNEVGGLVKALRLFQEKRVNMVHIESRKSRRRSSEVEIFVDCECGKTEFNELIQLLKFQTTIVTLNPPENIWTEEEELEDVPWFPRKISELDKCSHRVLMYGSELDADHPGFKDNVYRQRRKYFVDVAMGYKYGPRLLAAIGDWEFQLFSVSSSLSSSSLCMLSVHILMDVRSIVVAVDI

SEQ ID NO: 68408 - protein, 490 aa, Homo sapiens
MQPAMMMFSSKYWARRGFSLDSAVPEEHQLLGSSTLNKPNSGKNDDKGNKGSSKREAATESGKTAVVFSLKNEVGGLVKALRLFQEKRVNMVHIESRKSRRRSSEVEIFVDCECGKTEFNELIQLLKFQTTIVTLNPPENIWTEEEELEDVPWFPRKISELDKCSHRVLMYGSELDADHPGFKDNVYRQRRKYFVDVAMGYKYGQPIPRVEYTEEETKTWGVVFRELSKLYPTHACREYLKNFPLLTKYCGYREDNVPQLEDVSMFLKERSGFTVRPVAGYLSPRDFLAGLAYRVFHCTQYIRHGSDPLYTPEPDTCHELLGHVPLLADPKFAQFSQEIGLASLGASDEDVQKLATCYFFTIEFGLCKQEGQLRAYGAGLLSSIGELKHALSDKACVKAFDPKTTCLQECLITTFQEAYFVSESFEEAKEKMRDFAKSITRPFSVYFNPYTQSIEILKDTRSIENVVQDLRSDLNTVCDALNKMNQYLGI

SEQ ID NO: 68409 - protein, 174 aa, Homo sapiens
MSSAAADHWAWLLVLSFVFGCNVLRILLPSFSSFMSRVLQKDAEQESQMRAEIQDMKQELSTVNMMDEFARYARLERKINKMTDKLKTHVKARTAQLAKIKWVISVAFYVLQAALMISLIWKYYSVPVAVVPSKWITPLDRLVAFPTRVAGGVGITCWILVCNKVVAIVLHPFS

SEQ ID NO: 68410 - protein, 140 aa, Homo sapiens
MSRVLQKDAEQESQMRAEIQDMKQELSTVNMMDEFARYARLERKINKMTDKLKTHVKARTAQLAKIKWVISVAFYVLQAALMISLIWKYYSVPVAVVPSKWITPLDRLVAFPTRVAGGVGITCWILVCNKVVAIVLHPFS

SEQ ID NO: 68411 - protein, 140 aa, Homo sapiens; identical to SEQ ID NO: 68410

SEQ ID NO: 68412 - protein, 172 aa, Homo sapiens
MSSAAADHWAWLLVLSFVFGCNVLRILLPSFSSFMSRVLQKDAEQESQMRAEIQDMKQELSTVNMMDEFARYARLERKINKMTDKLKTHVKARTAQLAKIKWVISVAFYVLQAALMISLIWKYYSVPVAVVPSKWITPLDRLVAFPTRVAVFSSSIWTSKCFSSPDKSILEK

SEQ ID NO: 68413 - protein, 360 aa, Homo sapiens
MALHSMRKARERWSFIRALHKGSAAAPALQKDSKKRVFSGIQPTGILHLGNYLGAIESWVRLQDEYDSVLYSIVDLHSITVPQDPAVLRQSILDMTAVLLACGINPEKSILFQQSQVSEHTQLSWILSCMVRLPRLQHLHQWKAKTTKQKHDGTVGLLTYPVLQAADILLYKSTHVPVGEDQVQHMELVQDLAQGFNKKYGEFFPVPESILTSMKKVKSLRDPSAKMSKSDPDKLATVRITDSPEEIVQKFRKAVTDFTSEVTYDPAGRAGVSNIVAVHAAVTGLSVEEVVRRSAGMNTARYKLAVADAVIEKFAPIKREIEKLKLDKDHLEKVLQIGSAKAKELAYTVCQEVKKLVGFL

SEQ ID NO: 68414 - protein, 220 aa, Homo sapiens
MALHSMRKARERWSFIRALHKGSAAAPALQKDSKKRVFSGIQPTGILHLGNYLGAIESWVRLQDEYDSVLYSIVDLHSITVPQDPAVLRQSILDMTAVLLACGINPEKSILFQQSQVSEHTQLSWILSCMVRLPRLQHLHQWKAKTTKQKHDGTVGLLTYPVLQAADILLYKSTHVPVGEDQVQHMELVQDLAQGFNKKYGEFFPVPESILSMCVLVFLT

SEQ ID NO: 68415 - protein, 266 aa, Homo sapiens
MTAVLLACGINPEKSILFQQSQVSEHTQLSWILSCMVRLPRLQHLHQWKAKTTKQKHDGTVGLLTYPVLQAADILLYKSTHVPVGEDQVQHMELVQDLAQGFNKKYGEFFPVPESILTSMKKVKSLRDPSAKMSKSDPDKLATVRITDSPEEIVQKFRKAVTDFTSEVTYDPAGRAGVSNIVAVHAAVTGLSVEEVVRRSAGMNTARYKLAVADAVIEKFAPIKREIEKLKLDKDHLEKVLQIGSAKAKELAYTVCQEVKKLVGFL

SEQ ID NO: 68416 - protein, 430 aa, Homo sapiens
MLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 68417 - protein, 471 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 68418 - protein, 430 aa, Homo sapiens; identical to SEQ ID NO: 68416

SEQ ID NO: 68419 - protein, 471 aa, Homo sapiens; identical to SEQ ID NO: 68417

SEQ ID NO: 68420 - protein, 227 aa, Homo sapiens
MLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFG

SEQ ID NO: 68421 - protein, 107 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRF

SEQ ID NO: 68422 - protein, 150 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAY

SEQ ID NO: 68423 - protein, 97 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKG

SEQ ID NO: 68424 - protein, 26 aa, Homo sapiens
MPNSEPASLLELFNSIATQGELVRSL

SEQ ID NO: 68425 - protein, 105 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIV

SEQ ID NO: 68426 - protein, 33 aa, Homo sapiens
MPNSEPASLLELFNSIATQGELVRSLKAGNASK

SEQ ID NO: 68427 - protein, 68 aa, Homo sapiens
MPNSEPASLLELFNSIATQGELVRSLKAGNASKDEIDSAVKMLVSLKMSYKAAAGEDYKADCPPGNPA

SEQ ID NO: 68428 - protein, 124 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERAT

SEQ ID NO: 68429 - protein, 86 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVD

SEQ ID NO: 68430 - protein, 55 aa, Homo sapiens
MPNSEPASLLELFNSIATQGELVRSLKAGNASKDEIDSAVKMLVSLKMSYKAAAG

SEQ ID NO: 68431 - protein, 63 aa, Homo sapiens
MPNSEPASLLELFNSIATQGELVRSLKAGNASKDEIDSAVKMLVSLKMSYKAAAGEDYKADCP

SEQ ID NO: 68432 - protein, 70 aa, Homo sapiens
MPNSEPASLLELFNSIATQGELVRSLKAGNASKDEIDSAVKMLVSLKMSYKAAAGEDYKADCPPGNPAPT

SEQ ID NO: 68433 - protein, 58 aa, Homo sapiens
MPNSEPASLLELFNSIATQGELVRSLKAGNASKDEIDSAVKMLVSLKMSYKAAAGEDY

SEQ ID NO: 68434 - protein, 140 aa, Homo sapiens
MLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTK

SEQ ID NO: 68435 - protein, 153 aa, Homo sapiens
MLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQ

SEQ ID NO: 68436 - protein, 224 aa, Homo sapiens
MLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKG

SEQ ID NO: 68437 - protein, 430 aa, Homo sapiens; identical to SEQ ID NO: 68416

SEQ ID NO: 68438 - protein, 114 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDK

SEQ ID NO: 68439 - protein, 58 aa, Homo sapiens; identical to SEQ ID NO: 68433

SEQ ID NO: 68440 - protein, 152 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYEN

SEQ ID NO: 68441 - protein, 471 aa, Homo sapiens; identical to SEQ ID NO: 68417

SEQ ID NO: 68442 - protein, 154 aa, Homo sapiens
MLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQM

SEQ ID NO: 68443 - protein, 212 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAY

SEQ ID NO: 68444 - protein, 346 aa, Homo sapiens
MSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKVQWLTPVNLALWEAEAGGSLEGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 68445 - protein, 285 aa, Homo sapiens
MVYCTTTWAIWNCQLLLGYKPLQNVTGLNTVGSCNTVAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 68446 - protein, 325 aa, Homo sapiens
MSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 68447 - protein, 167 aa, Homo sapiens
MSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKENWEKT

SEQ ID NO: 68448 - protein, 215 aa, Homo sapiens
MSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGLPFQIGAVSELQLPESNFLQNTSS

SEQ ID NO: 68449 - protein, 144 aa, Homo sapiens
MKSQWCRPVAMDLGVYQLRHFSISFLSSLLGTENASVRLDNSSSGASVVAIDNKIEQAMDLVKSHLMYAVREEVEVLKEQIKELIEKNSQLEQENNLLKTLASPEQLAQFQAQLQTGSPPATTQPQGTTQPPAQPASQGSGPTA

SEQ ID NO: 68450 - protein, 1073 aa, Homo sapiens
MHQPPESTAAAAAAADISARKMAHPAMFPRRGSGSGSASALNAAGTGVGSNATSSEDFPPPSLLQPPPPAASSTSGPQPPPPQSLNLLSQAQLQAQPLAPGGTQMKKKSGFQITSVTPAQISASISSNNSIAEDTESYDDLDESHTEDLSSSEILDVSLSRATDLGEPERSSSEETLNNFQEAETPGAVSPNQPHLPQPHLPHLPQQNVVINGNAHPHHLHHHHQIHHGHHLQHGHHHPSHVAVASASITGGPPSSPVSRKLSTTGSSDSITPVAPTSAVSSSGSPASVMTNMRAPSTTGGIGINSVTGTSTVNNVNITAVGSFNPNVTSSMLGNVNISTSNIPSAAGVSVGPGVTSGVNVNILSGMGNGTISSSAAVSSVPNAAAGMTGGSVSSQQQQPTVNTSRFRVVKLDSSSEPFKKGRWTCTEFYEKENAVPATEGVLINKVVETVKQNPIEVTSERESTSGSSVSSSVSTLSHYTESVGSGEMGAPTVVVQQQQQQQQQQQQQPALQGVTLQQMDFGSTGPQSIPAVSIPQSISQSQISQVQLQSQELSYQQKQGLQPVPLQATMSAATGIQPSPVNVVGVTSALGQQPSISSLAQPQLPYSQAAPPVQTPLPGAPPPQQLQYGQQQPMVSTQMAPGHVKSVTQNPASEYVQQQPILQTAMSSGQPSSAGVGAGTTVIPVAQPQGIQLPVQPTAVPAQPAGASVQPVGQAPAAVSAVPTGSQIANIGQQANIPTAVQQPSTQVPPSVIQQGAPPSSQVVPPAQTGIIHQGVQTSAPSLPQQLVIASQSSLLTVPPQPQGVEPVAQGIVSQQLPAVSSLPSASSISVTSQVSSTGPSGMPSAPTNLVPPQNIAQTPATQNGNLVQSVSQPPLIATNTNLPLAQQIPLSSTQFSAQSLAQAIGSQIEDARRAAEPSLVGLPQTISGDSGGMSAVSDGSSSSLAASASLFPLKVLPLTTPLVDGEDESSSGASVVAIDNKIEQAMDLVKSHLMYAVREEVEVLKEQIKELIEKNSQLEQENNLLKTLASPEQLAQFQAQLQTGSPPATTQPQGTTQPPAQPASQGSGPTA

SEQ ID NO: 68451 - protein, 41 aa, Homo sapiens
MKSQWCRPVAMDLGVYQLRHFSISFLSSLLGTENASVRLDN

SEQ ID NO: 68452 - protein, 142 aa, Homo sapiens
MHQPPESTAAAAAAADISARKMAHPAMFPRRGSGSGSASALNAAGTGVGSNATSSEDFPPPSLLQPPPPAASSTSGPQPPPPQSLNLLSQAQLQAQPLAPGGTQMKKKSGFQITSVTPAQISASISSNNSIAEDTESYDDLD

SEQ ID NO: 68453 - protein, 570 aa, Homo sapiens
MHQPPESTAAAAAAADISARKMAHPAMFPRRGSGSGSASALNAAGTGVGSNATSSEDFPPPSLLQPPPPAASSTSGPQPPPPQSLNLLSQAQLQAQPLAPGGTQMKKKSGFQITSVTPAQISASISSNNSIAEDTESYDDLDESHTEDLSSSEILDVSLSRATDLGEPERSSSEETLNNFQEAETPGAVSPNQPHLPQPHLPHLPQQNVVINGNAHPHHLHHHHQIHHGHHLQHGHHHPSHVAVASASITGGPPSSPVSRKLSTTGSSDSITPVAPTSAVSSSGSPASVMTNMRAPSTTGGIGINSVTGTSTVNNVNITAVGSFNPNVTSSMLGNVNISTSNIPSAAGVSVGPGVTSGVNVNILSGMGNGTISSSAAVSSVPNAAAGMTGGSVSSQQQQPTVNTSRFRVVKLDSSSEPFKKGRWTCTEFYEKENAVPATEGVLINKVVETVKQNPIEVTSERESTSGSSVSSSVSTLSHYTESVGSGEMGAPTVVVQQQQQQQQQQQQQPALQGVTLQQMDFGSTGPQSIPAVSIPQSISQSQISQVQLQSQELSYLTMKVVLLIVYLCM

SEQ ID NO: 68454 - protein, 200 aa, Homo sapiens
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 68455 - protein, 110 aa, Homo sapiens
MAFQPPYSSSLFRKRDNASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 68456 - protein, 200 aa, Homo sapiens; identical to SEQ ID NO: 68454

SEQ ID NO: 68457 - protein, 200 aa, Homo sapiens; identical to SEQ ID NO: 68454

SEQ ID NO: 68458 - protein, 77 aa, Homo sapiens
MDLVKNHLMYAVREEVEILKEQIRELVEKNSQLERENTLLKTLASPEQLEKFQSCLSPEEPAPESPQVPEAPGGSAV

SEQ ID NO: 68459 - protein, 134 aa, Homo sapiens
MNTEMYQTPMEVAVYQLHNFSISFFSSLLGGDVVSVKLDNSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 68460 - protein, 179 aa, Homo sapiens
MAQSKLDCRSPVGLDCCNCCLDLAHRSGLQRGSSGENNNPGSPTVSNFRQDSLEPVLRDPCYLINEGICNRNIDQTMLSILLFFHSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 68461 - protein, 123 aa, Homo sapiens
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAIDNKIEQA

SEQ ID NO: 68462 - protein, 25 aa, Homo sapiens
MDLVKNHLMYAVREEVEILKEQIRE

SEQ ID NO: 68463 - protein, 116 aa, Homo sapiens
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAI

SEQ ID NO: 68464 - protein, 58 aa, Homo sapiens
MAQSKLDCRSPVGLDCCNCCLDLAHRSGLQRGSSGENNNPGSPTVSNFRQLQEKLVFE

SEQ ID NO: 68465 - protein, 84 aa, Homo sapiens
MAQSKLDCRSPVGLDCCNCCLDLAHRSGLQRGSSGENNNPGSPTVSNFRQLQEKLVFENLNTDKLNSIMRQDSLEPVLRDPCYL

SEQ ID NO: 68466 - protein, 200 aa, Homo sapiens; identical to SEQ ID NO: 68454

SEQ ID NO: 68467 - protein, 100 aa, Homo sapiens
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLS

SEQ ID NO: 68468 - protein, 119 aa, Homo sapiens
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAIDNK

SEQ ID NO: 68469 - protein, 132 aa, Homo sapiens
MRQDSLEPVLRDPCYLINEGICNRNIDQTMLSILLFFHSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 68470 - protein, 124 aa, Homo sapiens
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAIDNKIEQAM

SEQ ID NO: 68471 - protein, 395 aa, Homo sapiens
MSGGKKKSSFQITSVTTDYEGPGSPGASDPPTPQPPTGPPPRLPNGEPSPDPGGKGTPRNGSPPPGAPSSRFRVVKLPHGLGEPYRRGRWTCVDVYERDLEPHSFGGLLEGIRGASGGAGGRSLDSRLELASLGLGAPTPPSGLSQGPTSWLRPPPTSPGPQARSFTGGLGQLVVPSKAKAEKPPLSASSPQQRPPEPETGESAGTSRAATPLPSLRVEAEAGGSGARTPPLSRRKAVDMRLRMELGAPEEMGQVPPLDSRPSSPALYFTHDASLVHKSPDPFGAVAAQKFSLAHSMLAISGHLDSDDDSGSGSLVGIDNKIEQAMDLVKSHLMFAVREEVEVLKEQIRELAERNAALEQENGLLRALASPEQLAQLPSSGVPRLGPPAPNGPSV

SEQ ID NO: 68472 - protein, 437 aa, Homo sapiens
MSGLDGVKRTTPLQTHSIIISDQVPSDQDAHQYLRLRDQSEATQVMAEPGEGGSETVALPPPPPSEEGGVPQDAAGRGGTPQIRVVGGRGHVAIKAGQEEGQPPAEGLAAASVVMAADRSLKKGVQGGEKALEICGAQRSASELTAGAEAEAEEVKTGKCATVSAAVAERESAEVVKEGLAEKEVMEEQMEVEEQPPEGEEIEVAEEDRLEEEAREEEGPWPLHEALRMDPLEAIQLELDTVNAQADRAFQQLEHKFGRMRRHYLERRNYIIQNIPGFWMTAFRNHPQLSAMIRGQDAEMLRYITNLEVKELRHPRTGCKFKFFFRRNPYFRNKLIVKEYEVRSSGRVVSLSTPIIWRRGHEPQSFIRRNQDLICSFFTWFSDHSLPESDKIAEIIKEDLWPNPLQYYLLREGVRRARRRPLREPVEIPRPFGFQSG

SEQ ID NO: 68473 - protein, 173 aa, Homo sapiens [sequence omitted]

SEQ ID NO: 68474 - protein, 693 aa, Homo sapiens
MDRPDEGPPAKTRRLSSSESPQRDPPPPPPPPPLLRLPLPPPQQRPRLQEETEAAQVLADMRGVGLGPALPPPPPYVILEEGGIRAYFTLGAECPGWDSTIESGYGEAPPPTESLEALPTPEASGGSLEIDFQVVQSSSFGGEGALETCSAVGWAPQRLVDPKSKEEAIIIVEDEDEDERESMRSSRRRRRRRRRKQRKVKRESRERNAERMESILQALEDIQLDLEAVNIKAGKAFLRLKRKFIQMRRPFLERRDLIIQHIPGFWVKAFLNHPRISILINRRDEDIFRYLTNLQVQDLRHISMGYKMKLYFQTNPYFTNMVIVKEFQRNRSGRLVSHSTPIRWHRGQEPQARRHGNQDASHSFFSWFSNHSLPEADRIAEIIKNDLWVNPLRYYLRERGSRIKRKKQEMKKRKTRGRCEVVIMEDAPDYYAVEDIFSEISDIDETIHDIKISDFMETTDYFETTDNEITDINENICDSENPDHNEVPNNETTDNNESADDHETTDNNESADDNNENPEDNNKNTDDNEENPNNNENTYGNNFFKGGFWGSHGNNQDSSDSDNEADEASDDEDNDGNEGDNEGSDDDGNEGDNEGSDDDDRDIEYYEKVIEDFDKDQADYEDVIEIISDESVEEEGIEEGIQQDEDIYEEGNYEEEGSEDVWEEGEDSDDSDLEDVLQVPNGWANPGKRGKTG

SEQ ID NO: 68475 - protein, 353 aa, Homo sapiens
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSISPTAFSRLRYLESLDLSHNGLTALPAESFTSSPLSDVNLSHNQLREVSVSAFTTHSQGRALHVDLSHNLIHRLVPHPTRAGLPAPTIQSLNLAWNRLHAVPNLRDLPLRYLSLDGNPLAVIGPGAFAGLGGLTHLSLASLQRLPELAPSGFRELPGLQVLDLSGNPKLNWAGAEVFSGLSSLQELDLSGTNLVPLPEALLLHLPALQSVSVGQDVRCRRLVREGTYPRRPGSSPKVALHCVDTRDSAARGPTIL

SEQ ID NO: 68476 - protein, 321 aa, Homo sapiens
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSSPLSDVNLSHNQLREVSVSAFTTHSQGRALHVDLSHNLIHRLVPHPTRAGLPAPTIQSLNLAWNRLHAVPNLRDLPLRYLSLDGNPLAVIGPGAFAGLGGLTHLSLASLQRLPELAPSGFRELPGLQVLDLSGNPKLNWAGAEVFSGLSSLQELDLSGTNLVPLPEALLLHLPALQSVSVGQDVRCRRLVREGTYPRRPGSSPKVALHCVDTRDSAARGPTIL

SEQ ID NO: 68477 - protein, 105 aa, Homo sapiens
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSISPTAFS

SEQ ID NO: 68478 - protein, 353 aa, Homo sapiens; identical to SEQ ID NO: 68475

SEQ ID NO: 68479 - protein, 150 aa, Homo sapiens
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSISPTAFSRLRYLESLDLSHNGLTALPAESFTSSPLSDVNLSHNQLREVSVSA

SEQ ID NO: 68480 - protein, 857 aa, Homo sapiens
MESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFAQFELSQGNVKKSKQLLQKAVERGAVPLEMLEIALRNLNLQKKQLLSEEEKKNLSASTVLTAQESFSGSLGHLQNRNNSCDSRGQTTKARFLYGENMPPQDAEIGYRNSLRQTNKTKQSCPFGRVPVNLLNSPDCDVKTDDSVVPCFMKRQTSRSECRDLVVPGSKPSGNDSCELRNLKSVQNSHFKEPLVSDEKSSELIITDSITLKNKTESSLLAKLEETKEYQEPEVPESNQKQWQSKRKSECINQNPAASSNHWQIPELARKVNTEQKHTTFEQPVFSVSKQSPPISTSKWFDPKSICKTPSSNTLDDYMSCFRTPVVKNDFPPACQLSTPYGQPACFQQQQHQILATPLQNLQVLASSSANECISVKGRIYSILKQIGSGGSSKVFQVLNEKKQIYAIKYVNLEEADNQTLDSYRNEIAYLNKLQQHSDKIIRLYDYEITDQYIYMVMECGNIDLNSWLKKKKSIDPWERKSYWKNMLEAVHTIHQHGIVHSDLKPANFLIVDGMLKLIDFGIANQMQPDTTSVVKDSQVGTVNYMPPEAIKDMSSSRENGKSKSKISPKSDVWSLGCILYYMTYGKTPFQQIINQISKLHAIIDPNHEIEFPDIPEKDLQDVLKCCLKRDPKQRISIPELLAHPYVQIQTHPVNQMAKGTTEEMKYVLGQLVGLNSPNSILKAAKTLYEHYSGGESHNSSSSKTFEKKRGKK

SEQ ID NO: 68481 - protein, 139 aa, Homo sapiens
MESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANC

SEQ ID NO: 68482 - protein, 176 aa, Homo sapiens
MESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFAQFELSQGNVKKSKQLLQKAVERGAVP

SEQ ID NO: 68483 - protein, 150 aa, Homo sapiens
MESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFA

SEQ ID NO: 68484 - protein, 856 aa, Homo sapiens
MESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFAQFELSQGNVKKSKQLLQKAVERGAVPLEMLEIALRNLNLQKKQLLSEEEKKNLSASTVLTAQESFSGSLGHLQNRNNSCDSRGQTTKARFLYGENMPPQDAEIGYRNSLRQTNKTKQSCPFGRVPVNLLNSPDCDVKTDDSVVPCFMKRQTSRSECRDLVVPGSKPSGNDSCELRNLKSVQNSHFKEPLVSDEKSSELIITDSITLKNKTESSLLAKLEETKEYQEPEVPESNQKQWQSKRKSECINQNPAASSNHWQIPELARKVNTEKHTTFEQPVFSVSKQSPPISTSKWFDPKSICKTPSSNTLDDYMSCFRTPVVKNDFPPACQLSTPYGQPACFQQQQHQILATPLQNLQVLASSSANECISVKGRIYSILKQIGSGGSSKVFQVLNEKKQIYAIKYVNLEEADNQTLDSYRNEIAYLNKLQQHSDKIIRLYDYEITDQYIYMVMECGNIDLNSWLKKKKSIDPWERKSYWKNMLEAVHTIHQHGIVHSDLKPANFLIVDGMLKLIDFGIANQMQPDTTSVVKDSQVGTVNYMPPEAIKDMSSSRENGKSKSKISPKSDVWSLGCILYYMTYGKTPFQQIINQISKLHAIIDPNHEIEFPDIPEKDLQDVLKCCLKRDPKQRISIPELLAHPYVQIQTHPVNQMAKGTTEEMKYVLGQLVGLNSPNSILKAAKTLYEHYSGGESHNSSSSKTFEKKRGKK

SEQ ID NO: 68485 - protein, 455 aa, Homo sapiens
MTTMAAATLLRATPHFSGLAAGRTFLLQGLLRLLKAPALPLLCRGLAVEAKKTYVRDKPHVNVGTIGHVDHGKTTLTAAITKILAEGGGAKFKKYEEIDNAPEERARGITINAAHVEYSTAARHYAHTDCPGHADYVKNMITGTAPLDGCILVVAANDGPMPQTREHLLLARQIGVEHVVVYVNKADAVQDSEMVELVELEIRELLTEFGYKGEETPVIVGSALCALEGRDPELGLKSVQKLLDAVDTYIPVPARDLEKPFLLPVEAVYSVPGRGTVVTGTLERGILKKGDECELLGHSKNIRTVVTGIEMFHKSLERAEAGDNLGALVRGLKREDLRRGLVMVKPGSIKPHQKVEAQVYILSKEEGGRHKPFVSHFMPVMFSLTWDMACRIILPPEKELAMPGEDLKFNLILRQPMILEKGQRFTLRDGNRTIGTGLVTNTLAMTEEEKNIKWG

SEQ ID NO: 68486 - protein, 542 aa, Homo sapiens
MPLRDETLREVWASDSGHEEESLSPEAPRRPKQRPAPAQRLRKKRTEAPESPCPTGSKPRKPGAGRTGRPREEPSPDPAQARAPQTVYARFLRDPEAKKRDPRETFLVARAPDAEDEEEEEEEDEEDEEEEAEEKKEKILLPPKKPLREKSSADLKERRAKAQGPRGDLGSPDPPPKPLRVRNKEAPAGEGTKMRKTKKKGSGEADKDPSGSPASARKSPAAMFLVGEGSPDKKALKKKGTPKGARKEEEEEEEAATVIKKSNQKGKAKGKGKKKAKEERAPSPPVEVDEPREFVLRPAPQGRTVRCRLTRDKKGMDRGMYPSYFLHLDTEKKVFLLAGRKRKRSKTANYLISIDPTNLSRGGENFIGKLRSNLLGNRFTVFDNGQNPQRGYSTNVASLRQELAAVIYETNVLGFRGPRRMTVIIPGMSAENERVPIRPRNASDGLLVRWQNKTLESLIELHNKPPVWNDDSGSYTLNFQGRVTQASVKNFQIVHADDPDYIVLQFGRVAEDAFTLDYRYPLCALQAFAIALSSFDGKLACE

SEQ ID NO: 68487 - protein, 489 aa, Homo sapiens
MPLRDETLREVWASDSGHEEESLSPEAPRRPKQRPAPAQRLRKKRTEAPESPCPTGSKPRKPGEEEEEEEDEEDEEEEAEEKKEKILLPPKKPLREKSSADLKERRAKAQGPRGDLGSPDPPPKPLRVRNKEAPAGEGTKMRKTKKKGSGEADKDPSGSPASARKSPAAMFLVGEGSPDKKALKKKGTPKGARKEEEEEEEAATVIKKSNQKGKAKGKGKKKAKEERAPSPPVEVDEPREFVLRPAPQGRTVRCRLTRDKKGMDRGMYPSYFLHLDTEKKVFLLAGRKRKRSKTANYLISIDPTNLSRGGENFIGKLRSNLLGNRFTVFDNGQNPQRGYSTNVASLRQELAAVIYETNVLGFRGPRRMTVIIPGMSAENERVPIRPRNASDGLLVRWQNKTLESLIELHNKPPVWNDDSGSYTLNFQGRVTQASVKNFQIVHADDPDYIVLQFGRVAEDAFTLDYRYPLCALQAFAIALSSFDGKLACE

SEQ ID NO: 68488 - protein, 186 aa, Homo sapiens
MPLRDETLREVWASDSGHEEESLSPEAPRRPKQRPAPAQRLRKKRTEAPESPCPTGSKPRKPGEEEEEEEDEEDEEEEAEEKKEKILLPPKKPLREKSSADLKERRAKAQGPRGDLGSPDPPPKPLRVRNKEAPAGEGTKMRKTKKKGSGEADKDPSGSPASARKSPAAMFLVGEGSPDKKALKKK

SEQ ID NO: 68489 - protein, 520 aa, Homo sapiens
MSQDNDTLMRDILGHELAAMRLQKLEQQRRLFEKKQRQKRQELLMVQANPDASPWLWRSCLREERLLGDRGLGNPFLRKKVSEAHLPSGIHSALGTVSCGGDGRGERGLPTPRTEAVFRNLGLQSPFLSWLPDNSDAELEEVSVENGSVSPPPFKQSPRIRRKGWQAHQRPGTRAEGESDSQDMGDAHKSPNMGPNPGMDGDCVYENLAFQKEEDLEKKREASESTGTNSSAAHNEELSKALKGEGGTDSDHMRHEASLAIRSPCPGLEEDMEAYVLRPALPGTMMQCYLTRDKHGVDKGLFPLYYLYLETSDSLQRFLLAGRKRRRSKTSNYLISLDPTHLSRDGDNFVGKVRSNVFSTKFTIFDNGVNPDREHLTRNTARIRQELGAVCYEPNVLGYLGPRKMTVILPGTNSQNQRINVQPLNEQESLLSRYQRGDKQGLLLLHNKTPSWDKENGVYTLNFHGRVTRASVKNFQIVDPKHQEHLVLQFGRVGPDTFTMDFCFPFSPLQAFSICLSSFN

SEQ ID NO: 68490 - protein, 442 aa, Homo sapiens
MEASRCRLSPSGDSVFHEEMMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTDTGTSGSATAAQPADNLLGDIDDLEDFVYSPAPQGVTVRCRIIRDKRGMDRGLFPTYYMYLEKEENQKIFLLAARKRKKSKTANYLISIDPVDLSREGESYVGKLRSNLMGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDSKLACE

SEQ ID NO: 68491 - protein, 442 aa, Homo sapiens; identical to SEQ ID NO: 68490

SEQ ID NO: 68492 - protein, 170 aa, Homo sapiens
MMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTFSSFCQKTEDTGYRHFRFCYCRPTS

SEQ ID NO: 68493 - protein, 266 aa, Homo sapiens
MLKTPWILLPSQDFRSVSKSMDTGTSGSATAAQPADNLLGDIDDLEDFVYSPAPQGVTVRCRIIRDKRGMDRGLFPTYYMYLEKEENQKIFLLAARKRKKSKTANYLISIDPVDLSREGESYVGKLRSNLMGTKFTVYDRGICPMKGRGLVGAAHTRQELAAISYNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDSKLACE

SEQ ID NO: 68494 - protein, 501 aa, Homo sapiens
MEASRCRLSPSGDSVFHEEMMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTDTGTSGSATAAQPADNLLGDIDDLEDFVYSPAPQGVTVRCRIIRDKRGMDRGLFPTYYMYLEKEENQKIFLLAARKRKKSKTANYLISIDPVDLSREGESYVGKLRSNLMGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDKCIQTLRMQELCELHRQHHSAASLVHRTVCQRWVGHPWRLLPQTSLLWTDLSPPPVVPAPHQISM

SEQ ID NO: 68495 - protein, 422 aa, Homo sapiens
MALSDEPAAGGPEEEAEDETLAFGAALEAFGESAETRALLGRLREVHGGGAEREVALERFREWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVD

SEQ ID NO: 68496 - protein, 998 aa, Homo sapiens
MDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVDFPSATLVCVGTVQMYAHTHLRLGAPGPHCAHGSALPRFCEMVQFPGDVRRQALLQLCLLLCHRFPLIRKTTASQVYETLLTYSDVVGADVLDEVVTVLSDTAWDAELAVVREQRNRLCDLLGVPPSWCPTWCLLKPVLEPIPHPCLVRMSCS

SEQ ID NO: 68497 - protein, 1192 aa, Homo sapiens
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCEMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 68498 - protein, 311 aa, Homo sapiens
MAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQPCICSWGLMSPESKAEFCVCVCRISLGRQCVHLSGL

SEQ ID NO: 68499 - protein, 750 aa, Homo sapiens
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDSLWLLVGLGRPSRLPSERPAPAGSHRFKSSYPHFPRGRKFC

SEQ ID NO: 68500 - protein, 184 aa, Homo sapiens
MKGIQSDPQALGSFSGTLLQIFEDNLLNERVSVPLLKTLDHVLTHGCFDIFTTEEDHPFAVKLLALCKKEIKNSKDIQKLLSGIAVFCEMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 68501 - protein, 527 aa, Homo sapiens
MSDTLTADVIGRRVEVNGEHATVRFAGVVPPVAGPWLGVEWDNPERGKHDGSHEGTVYFKCRHPTGGSFIRPNKVNFGTDFLTAIKNRYVLEDGPEEDRKEQIVTIGNKPVETIGFDSIMKQQSQLSKLQEVSLRNCAVSCAGEKGGVAEACPNIRKVDLSKNLLSSWDEVIHIADQLRHLEVLNVSENKLKFPSGSVLTGTLSVLKVLVLNQTGITWAEVLRCVAGCPGLEELYLESNNIFISERPTDVLQTVKLLDLSSNQLIDENQLYLIAHLPRLEQLILSDTGISSLHFPDAGIGCKTSMFPSLKYLVVNDNQISQWSFFNELEKLPSLRALSCLRNPLTKEDKEAETARLLIIASIGQLKTLNKCEILPEERRRAELDYRKAFGNEWKQAGGHKDPEKNRLSEEFLTAHPRYQFLCLKYGAPEDWELKTQQPLMLKNQLLTLKIKYPHQLDQKVLEKQLPGSMTIQKVKGLLSRLLKVPVSDLLLSYESPKKPGREIELENDLKSLQFYSVENGDCLLVRW

SEQ ID NO: 68502 - protein, 527 aa, Homo sapiens; identical to SEQ ID NO: 68501

SEQ ID NO: 68503 - protein, 578 aa, Homo sapiens
MSDTLTADVIGRRVEVNGEHATVRFAGVVPPVAGPWLGVEWDNPERGKHDGSHEGTVYFKCRHPTGGSFIRPNKVNFGTDFLTAIKNRYVLEDGPEEDRKEQIVTIGNKPVETIGFDSIMKQQSQLSKLQEVSLRNCAVSCAGEKGGVAEACPNIRKVDLSKNLLSSWDEVIHIADQLRHLEVLNVSENKLKFPSGSVLTGTLSVLKVLVLNQTGITWAEAHAQCGGSRHGLDMQKDASKFVDLCVLQKCSTSNCIISAKDHTSMRMNVAKVLRCVAGCPGLEELYLESNNIFISERPTDVLQTVKLLDLSSNQLIDENQLYLIAHLPRLEQLILSDTGISSLHFPDAGIGCKTSMFPSLKYLVVNDNQISQWSFFNELEKLPSLRALSCLRNPLTKEDKEAETARLLIIASIGQLKTLNKCEILPEERRRAELDYRKAFGNEWKQAGGHKDPEKNRLSEEFLTAHPRYQFLCLKYGAPEDWELKTQQPLMLKNQLLTLKIKYPHQLDQKVLEKQLPGSMTIQKVKGLLSRLLKVPVSDLLLSYESPKKPGREIELENDLKSLQFYSVENGDCLLVRW

SEQ ID NO: 68504 - protein, 666 aa, Homo sapiens
MIHELLLALSGYPGSIFTWNKRSGLQVSQDFPFLHPSETSVLNRLCRLGTDYIRFTEFIEQYTGHVQQQDHHPSQQGQGGLHGIYLRAFCTGLDSVLQPYRQALLDLEQEFLGDPHLSISHVNYFLDQFQLLFPSVMVVVEQIKSQKIHGCQILETVYKHSCGGLPPVRSALEKILAVCHGVMYKQLSAWMLHGLLLDQHEEFFIKQGPSSGNVSAQPEEDEEDLGIGGLTGKQLRELQDLRLIEEENMLAPSLKQFSLRVEILPSYIPVRVAEKILFVGESVQMFENQNVNLTRKGSILKNQEDTFAAELHRLKQQPLFSLVDFEQVVDRIRSTVAEHLWKLMVEESDLLGQLKIIKDFYLLGRGELFQAFIDTAQHMLKTPPTAVTEHDVNVAFQQSAHKVLLDDDNLLPLLHLTIEYHGKEHKDATQAREGPSRETSPREAPASGWAALGLSYKVQWPLHILFTPAVLEKYNVVFKYLLSVRRVQAELQHCWALQMQRKHLKSNQTDAIKWRLRNHMAFLVDNLQYYLQVDVLESQFSQLLHQINSTRDFESIRLAHDHFLSNLLAQSFILLKPVFHCLNEILDLCHSFCSLVSQNLGPLDERGAAQLSILVKGFSRQSSLLFKILSSVRNHQINSDLAQLLLRLDYNKYYTQAGGTLGSFGM

SEQ ID NO: 68505 - protein, 219 aa, Homo sapiens
MADKAKPAKAANRTPPKSPGDPSKDRAAKRLSLESEGAGEGAAASPELSALEEAFRRFAVHGDARATGREMHGKNWSKLCKDCQVIDGRNVTVTDVDIVFSKIKGKSCRTITFEQFQEALEELAKKRFKDKSSEEAVREVHRLIEGKAPIISGVTKAISSPTVSRLTDTTKFTGSHKERFDPSGKGKGKAGRVDLVDESGYVSGYKHAGTYDQKVQGGK

SEQ ID NO: 68506 - protein, 377 aa, Homo sapiens
MYTFVVRDENSSVYAEVSRLLLATGHWKRLRRDNPRFNLMLGERNRLPFGRLGHEPGLVQLVNYYRGADKLCRKASLVKLIKTSPELAESCTWFPESYVIYPTNLKTPVAPAQNGIQPPISNSRTDEREFFLASYNRKKEDGEGNVWIAKSSAGAKGEGILISSEASELLDFIDNQGQVHVIQKYLEHPLLLEPGHRKFDIRSWVLVDHQYNIYLYREGVLRTASEPYHVDNFQDKTCHLTNHCIQKEYSKNYGKYEEGNEMFFKEFNQYLTSALNITLESSILLQIKHIIRNCLLSVEPAISTKHLPYQSFQLFGFDFMVDEELKVWLIEVNGAPACAQKLYAELCQGIVDIAISSVFPPPDVEQPQTQPAAFIKL

SEQ ID NO: 68507 - protein, 423 aa, Homo sapiens
MAGKVKWVTDIEKSVLINNFEKRGWVQVTENEDWNFYWMSVQTIRNVFSVEAGYRLSDDQIVNHFPNHYELTRKDLMVKNIKRYRKELEKEGSPLAEKDENGKYLYLDFVPVTYMLPADYNLFVEEFRKSPSSTWIMKPCGKAQGKGIFLINKLSQIKKWSRDSKTSSFVSQSNKEAYVISLYINNPLLIGGRKFDLRLYVLVSTYRPLRCYMYKLGFCRFCTVKYTPSTSELDNMFVHLTNVAIQKHGEDYNHIHGGKWTVSNLRLYLESTRGKEVTSKLFDEIHWIIVQSLKAVAPVMNNDKHCFECYGYDIIIDDKLKPWLIEVNASPSLTSSTANDRILKYNLINDTLNIAVPNGEIPDCKWNKSPPKEVLGNYEILYDEELAQGDGADRELRSRQGQSLGPRAGRSRDSGRAVLTTWK

SEQ ID NO: 68508 - protein, 394 aa, Homo sapiens
MAGKVKWVTDIEKSVLINNFEKRGWVQVTENEDWNFYWMSVQTIRNVFSVEAGYRLSDDQIVNHFPNHYELTRKDLMVKNIKRYRKELEKEGSPLAEKDENGKYLYLDFVPVTYMLPADYNLFVEEFRKSPSSTWIMKPCGKAQGKGIFLINKLSQIKKWSRDSKTSSFVSQSNKEAYVISLYINNPLLIGGRKFDLRLYVLVSTYRPLRCYMYKLGFCRFCTVKYTPSTSELDNMFVHLTNVAIQKHGEDYNHIHGGKWTVSNLRLYLESTRGKEVTSKLFDEIHWIIVQSLKAVAVNASPSLTSSTANDRILKYNLINDTLNIAVPNGEIPDCKWNKSPPKEVLGNYEILYDEELAQGDGADRELRSRQGQSLGPRAGRSRDSGRAVLTTWK

SEQ ID NO: 68509 - protein, 59 aa, Homo sapiens
MAGKVKWVTDIEKSVLINNFEKRGWVQVTENEDWNFYWLLDLPEFRYRSCLNEFPDFRV

SEQ ID NO: 68510 - protein, 355 aa, Homo sapiens
MPHQPTILLNTVSASASPCLHPGAQNIPSPTGLPRCRSGSHTIGPFSSFQSAAHIYSQKLSRPSSAKAAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASKGSSAEGQLNGLQSSLNPAAFVPITSSTVNSHTAL

SEQ ID NO: 68511 - protein, 1281 aa, Homo sapiens
MPIVMARDLEETASSSEDEEVISQEDHPCIMWTGGCRRIPVLVFHADAILTKDNNIRVIGERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARFATVRYDQGAKNIRNQFMHLTNYSVNKKSGDYVSCDDPEVEDYGNKWSMSAMLRYLKQEGRDTTALMAHVEDLIIKTIISAELAIATACKTFVPHRSSCFELYGFDVLIDSTLKPWLLEVNLSPSLACDAPLDLKIKASMISDMFTVVGFVCQDPAQRASTRPIYPTFESSRRNPFQKPQRCRPLSASDAEMKNLVGSAREKGPGKLGGSVLGLSMEEIKVLRRVKEENDRRGGFIRIFPTSETWEIYGSYLEHKTSMNYMLATRLFQDRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASKGSSAEGQLNGLQSSLNPAAFVPITSSTDPAHTKI

SEQ ID NO: 68512 - protein, 817 aa, Homo sapiens
MKEIKVLRRVKEENDRRGGFIRIFPTSETWEIYGSYLEHKTSMNYMLATRLFQDRGNPRRSLLTGRTRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASNTRFRSSFQNYLWYFFQAVS

SEQ ID NO: 68513 - protein, 778 aa, Homo sapiens
MAHVEDLIIKTIISAELAIATACKTFVPHRSSCFELYGFDVLIDSTLKPWLLEVNLSPSLACDAPLDLKIKASMISDMFTVVGFVCQDPAQRASTRPIYPTFESSRRNPFQKPQRCRPLSASDAEMKNLVGSAREKGPGKLGGSVLGLSMEEIKVLRRVKEENDRRGGFIRIFPTSETWEIYGSYLEHKTSMNYMLATRLFQDRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAGSCYLNKHHSGIAKTQKEGEDASLYSKRYNQSMVTAELQRLAEKQAARQYSPSSHTDPWKYDRSIRMCSPLNILEPEFKKYLMGIYSPHSSKKKKK

SEQ ID NO: 68514 - protein, 584 aa, Homo sapiens
MRIGTPTAGPGPSAVMEGCLGVAELRKLSTFSAYLEDHSYNVEQIWRDIEDVIIKTLISAHPIIRHNYHTCFPNHTLNSACFEILGFDILLDHKLKPWLLEVNHSPSFSTDSRLDKEVKDGLLYDTLVLINLESCDKKKVLEEERQRGQFLQQCCSREMRIEEAKGFRAVQLKKTETYEKENCGGFRLIYPSLNSEKYEKFFQDNNSLFQNTVASRAREEYARQLIQELRLKREKKPFQMKKKVEMQGESAGEQVRKKGMRGWQQKQQQKDKAATQASKQYIQPLTLVSYTPDLLLSVRGERKNETDSSLNQEAPTEEASSVFPKLTSAKPFSSLPDLRNINLSSSKLEPSKPNFSIKEAKSASAVNVFTGTVHLTSVETTPESTTQLSISPKSPPTLAVTASSEYSGPETDRVVSFKCKKQQTPPHLTQKKMLKSFLPTKSKSFWESPNTNWTLLKSDMNKPHLISELLTKLQLSGKLSFFPAHYNPKLGMNNLSQNPSLPGECHSRSDSSGEKRQLDVSSLLLQSPQSYNVTLRDLLVIATPAQLDPRPCRSHASAMRDPCMQDQEAYSHCLISGQKGCERS

SEQ ID NO: 68515 - protein, 843 aa, Homo sapiens
MPQCPTLESQEGENSEEKGDSSKEDPKETVALAFVRENPGAQNGLQNAQQQGKKKRKKKRLVINLSSCRYESVRRAAQQYGFREGGEDDDWTLYWTDYSVSLERVMEMKSYQKINHFPGMSEICRKDLLARNMSRMLKMFPKDFRFFPRTWCLPADWGDLQTYSRSRKNKTYICKPDSGCQGKGIFITRTVKEIKPGEDMICQLYISKPFIIDGFKFDLRIYVLVTSCDPLRIFVYNEGLARFATTSYSRPCTDNLDDICMHLTNYSINKHSSNFSRDAHSGSKRKLSTFSAYLEDHSYNVEQIWRDIEDVIIKTLISAHPIIRHNYHTCFPNHTLNSACFEILGFDILLDHKLKPWLLEVNHSPSFSTDSRLDKEVKDGLLYDTLVLINLESCDKKKVLEEERQRGQFLQQCCSREMRIEEAKGFRAVQLKKTETYEKENCGGFRLIYPSLNSEKYEKFFQDNNSLFQNTVASRAREEYARQLIQELRLKREKKPFQMKKKVEMQGESAGEQVRKKGMRGWQQKQQQKDKAATQASKQYIQPLTLVSYTPDLLLSVRGERKNETDSSLNQEAPTEEASSVFPKLTSAKPFSSLPDLRNINLSSSKLEPSKPNFSIKEAKSASAVNVFTGTVHLTSVETTPESTTQLSISPKSPPTLAVTASSEYSGPETDRVVSFKCKKQQTPPHLTQKKMLKSFLPTKSKSFWESPNTNWTLLKSDMNKPHLISELLTKLQLSGKLSFFPAHYNPKLGMNNLSQNPSLPGECHSRSDSSGEKRQLDVSSLLLQSPQSYNVTLRDLLVIATPAQLDPRPCRSHASAMRDPCMQDQEAYSHCLISGQKGCERS

SEQ ID NO: 68516 - protein, 185 aa, Homo sapiens
QPMGALLLHPSRRGPAGVVASWTSSPAGRDGGVGIAGAWYFPRASSQAREMPQCPTLESQEGENSEEKGDSSKEDPKETVALAFVRENPGAQNGLQNAQQQGKKKRKKKRMPLKNSRKRRFPCFKKALICPGNLVRLQYDSTILTYQDPTAACAFQFLFNISPCLAPFRLIDEGKLVHFLIHSFP

SEQ ID NO: 68517 - protein, 569 aa, Homo sapiens
MEGCLGVAELRKLSTFSAYLEDHSYNVEQIWRDIEDVIIKTLISAHPIIRHNYHTCFPNHTLNSACFEILGFDILLDHKLKPWLLEVNHSPSFSTDSRLDKEVKDGLLYDTLVLINLESCDKKKVLEEERQRGQFLQQCCSREMRIEEAKGFRAVQLKKTETYEKENCGGFRLIYPSLNSEKYEKFFQDNNSLFQNTVASRAREEYARQLIQELRLKREKKPFQMKKKVEMQGESAGEQVRKKGMRGWQQKQQQKDKAATQASKQYIQPLTLVSYTPDLLLSVRGERKNETDSSLNQEAPTEEASSVFPKLTSAKPFSSLPDLRNINLSSSKLEPSKPNFSIKEAKSASAVNVFTGTVHLTSVETTPESTTQLSISPKSPPTLAVTASSEYSGPETDRVVSFKCKKQQTPPHLTQKKMLKSFLPTKSKSFWESPNTNWTLLKSDMNKPHLISELLTKLQLSGKLSFFPAHYNPKLGMNNLSQNPSLPGECHSRSDSSGEKRQLDVSSLLLQSPQSYNVTLRDLLVIATPAQLDPRPCRSHASAMRDPCMQDQEAYSHCLISGQKGCERS

SEQ ID NO: 68518 - protein, 891 aa, Homo sapiens
MGALLLHPSRRGPAGVVASWTSSPAGRDGGVGIAGAWYFPRASSQAREMPQCPTLESQEGENSEEKGDSSKEDPKETVALAFVRENPGAQNGLQNAQQQGKKKRKKKRLVINLSSCRYESVRRAAQQYGFREGGEDDDWTLYWTDYSVSLERVMEMKSYQKINHFPGMSEICRKDLLARNMSRMLKMFPKDFRFFPRTWCLPADWGDLQTYSRSRKNKTYICKPDSGCQGKGIFITRTVKEIKPGEDMICQLYISKPFIIDGFKFDLRIYVLVTSCDPLRIFVYNEGLARFATTSYSRPCTDNLDDICMHLTNYSINKHSSNFSRDAHSGSKRKLSTFSAYLEDHSYNVEQIWRDIEDVIIKTLISAHPIIRHNYHTCFPNHTLNSACFEILGFDILLDHKLKPWLLEVNHSPSFSTDSRLDKEVKDGLLYDTLVLINLESCDKKKVLEEERQRGQFLQQCCSREMRIEEAKGFRAVQLKKTETYEKENCGGFRLIYPSLNSEKYEKFFQDNNSLFQNTVASRAREEYARQLIQELRLKREKKPFQMKKKVEMQGESAGEQVRKKGMRGWQQKQQQKDKAATQASKQYIQPLTLVSYTPDLLLSVRGERKNETDSSLNQEAPTEEASSVFPKLTSAKPFSSLPDLRNINLSSSKLEPSKPNFSIKEAKSASAVNVFTGTVHLTSVETTPESTTQLSISPKSPPTLAVTASSEYSGPETDRVVSFKCKKQQTPPHLTQKKMLKSFLPTKSKSFWESPNTNWTLLKSDMNKPHLISELLTKLQLSGKLSFFPAHYNPKLGMNNLSQNPSLPGECHSRSDSSGEKRQLDVSSLLLQSPQSYNVTLRDLLVIATPAQLDPRPCRSHASAMRDPCMQDQEAYSHCLISGQKGCERS

SEQ ID NO: 68519 - protein, 101 aa, Homo sapiens
MPQCPTLESQEGENSEEKGDSSKEDPKETVALAFVRENPGAQNGLQNAQQQGKKKRKKKRLVINLSSCRYESVRRAAQQYGFREGGEDDDWTLYWTDYSVS

SEQ ID NO: 68520 - protein, 451 aa, Homo sapiens
MRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGVDSVEGEGEEEGEEY

SEQ ID NO: 68521 - protein, 451 aa, Homo sapiens; identical to SEQ ID NO: 68520

SEQ ID NO: 68522 - protein, 383 aa, Homo sapiens
MIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGTDSFEEENEGEEF

SEQ ID NO: 68523 - protein, 449 aa, Homo sapiens
MRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGTDSFEEENEGEEF

SEQ ID NO: 68524 - protein, 451 aa, Homo sapiens
MREIVHIQIGQCGNQIGAKFWEMIGEEHGIDLAGSDRGASALQLERISVYYNEAYGRKYVPRAVLVDLEPGTMDSIRSSKLGALFQPDSFVHGNSGAGNNWAKGHYTEGAELIENVLEVVRHESESCDCLQGFQIVHSLGGGTGSGMGTLLMNKIREEYPDRIMNSFSVMPSPKVSDTVVEPYNAVLSIHQLIENADACFCIDNEALYDICFRTLKLTTPTYGDLNHLVSLTMSGITTSLRFPGQLNADLRKLAVNMVPFPRLHFFMPGFAPLTAQGSQQYRALSVAELTQQMFDARNTMAACDLRRGRYLTVACIFRGKMSTKEVDQQLLSVQTRNSSCFVEWIPNNVKVAVCDIPPRGLSMAATFIGNNTAIQEIFNRVSEHFSAMFKRKAFVHWYTSEGMDINEFGEAENNIHDLVSEYQQFQDAKAVLEEDEEVTEEAEMEPEDKGH

SEQ ID NO: 68525 - protein, 445 aa, Homo sapiens [sequence omitted]

SEQ ID NO: 68526 - protein, 450 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLAVNMVPFPRLHFFMPGFAPLTARGSQQYRALTVPELTQQMFDAKNMMAACDPRHGRYLTVATVFRGRMSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 68527 - protein, 378 aa, Homo sapiens
MDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLAVNMVPFPRLHFFMPGFAPLTARGSQQYRALTVPELTQQMFDAKNMMAACDPRHGRYLTVATVFRGRMSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 68528 - protein, 444 aa, Homo sapiens
MREIVHIQAGQCGNQIGAKFWEVISDEHGIDPTGTYHGDSDLQLDRISVYYNEATGGKYVPRAILVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 68529 - protein, 372 aa, Homo sapiens
MDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 68530 - protein, 444 aa, Homo sapiens; identical to SEQ ID NO: 68528

SEQ ID NO: 68531 - protein, 372 aa, Homo sapiens; identical to SEQ ID NO: 68529

SEQ ID NO: 68532 - protein, 426 aa, Homo sapiens
MFWEVISDEHGIDPTGTYHGDSDLQLDRISVYYNEATGGKYVPRAILVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 68533 - protein, 372 aa, Homo sapiens; identical to SEQ ID NO: 68529

SEQ ID NO: 68534 - protein, 372 aa, Homo sapiens; identical to SEQ ID NO: 68529

SEQ ID NO: 68535 - protein, 426 aa, Homo sapiens; identical to SEQ ID NO: 68532

SEQ ID NO: 68536 - protein, 426 aa, Homo sapiens; identical to SEQ ID NO: 68532

SEQ ID NO: 68537 - protein, 372 aa, Homo sapiens; identical to SEQ ID NO: 68529

SEQ ID NO: 68538 - protein, 426 aa, Homo sapiens; identical to SEQ ID NO: 68532

SEQ ID NO: 68539 - protein, 444 aa, Homo sapiens; identical to SEQ ID NO: 68528

SEQ ID NO: 68540 - protein, 426 aa, Homo sapiens; identical to SEQ ID NO: 68532

SEQ ID NO: 68541 - protein, 372 aa, Homo sapiens; identical to SEQ ID NO: 68529

SEQ ID NO: 68542 - protein, 444 aa, Homo sapiens; identical to SEQ ID NO: 68528

SEQ ID NO: 68543 - protein, 444 aa, Homo sapiens; identical to SEQ ID NO: 68528

SEQ ID NO: 68544 - protein, 444 aa, Homo sapiens; identical to SEQ ID NO: 68528

SEQ ID NO: 68545 - protein, 353 aa, Homo sapiens
MREIVHIQAGQCGNQIGAKFWEVISDEHGIDPTGTYHGDSDLQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 68546 - protein, 426 aa, Homo sapiens; identical to SEQ ID NO: 68532

SEQ ID NO: 68547 - protein, 372 aa, Homo sapiens; identical to SEQ ID NO: 68529

SEQ ID NO: 68548 - protein, 426 aa, Homo sapiens; identical to SEQ ID NO: 68532

SEQ ID NO: 68549 - protein, 426 aa, Homo sapiens; identical to SEQ ID NO: 68532

SEQ ID NO: 68550 - protein, 372 aa, Homo sapiens; identical to SEQ ID NO: 68529

SEQ ID NO: 68551 - protein, 444 aa, Homo sapiens; identical to SEQ ID NO: 68528

SEQ ID NO: 68552 - protein, 243 aa, Homo sapiens
MREIVHIQAGQCGNQIGAKFWEVISDEHGIDPTGTYHGDSDLQLDRISVYYNEATGGKYVPRAILVDLEPGTMDSVRSGPFGQIFRPDNFVFGQSGAGNNWAKGHYTEGAELVDSVLDVVRKEEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 68553 - protein, 372 aa, Homo sapiens; identical to SEQ ID NO: 68529

SEQ ID NO: 68554 - protein, 372 aa, Homo sapiens; identical to SEQ ID NO: 68529

SEQ ID NO: 68555 - protein, 444 aa, Homo sapiens; identical to SEQ ID NO: 68528

SEQ ID NO: 68556 - protein, 372 aa, Homo sapiens; identical to SEQ ID NO: 68529

SEQ ID NO: 68557 - protein, 372 aa, Homo sapiens; identical to SEQ ID NO: 68529

SEQ ID NO: 68558 - protein, 372 aa, Homo sapiens; identical to SEQ ID NO: 68529

SEQ ID NO: 68559 - protein, 372 aa, Homo sapiens; identical to SEQ ID NO: 68529

SEQ ID NO: 68560 - protein, 372 aa, Homo sapiens; identical to SEQ ID NO: 68529

SEQ ID NO: 68561 - protein, 372 aa, Homo sapiens; identical to SEQ ID NO: 68529

SEQ ID NO: 68562 - protein, 207 aa, Homo sapiens
MGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWPQQCQDSRL

SEQ ID NO: 68563 - protein, 415 aa, Homo sapiens
MREIVHIQAGQCGNQIGAKFWEVISDEHGIDPTGTYHGDSDLQLDRISVYYNEATGGKYVPRAILVDLEPGTMDSVRSGPFGQIFRPDNFVFGQSGAGNNCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEE

SEQ ID NO: 68564 - protein, 353 aa, Homo sapiens; identical to SEQ ID NO: 68545

SEQ ID NO: 68565 - protein, 353 aa, Homo sapiens; identical to SEQ ID NO: 68545

SEQ ID NO: 68566 - protein, 435 aa, Homo sapiens
MREIVHIQAGQCGNQIGAKFWEVISDEHGIDPTGTYHGDSDLQLDRISVYYNEATGGKYVPRAILVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEGGGL

SEQ ID NO: 68567 - protein, 435 aa, Homo sapiens; identical to SEQ ID NO: 68566

SEQ ID NO: 68568 - protein, 435 aa, Homo sapiens; identical to SEQ ID NO: 68566

SEQ ID NO: 68569 - protein, 415 aa, Homo sapiens; identical to SEQ ID NO: 68563

SEQ ID NO: 68570 - protein, 415 aa, Homo sapiens; identical to SEQ ID NO: 68563

SEQ ID NO: 68571 - protein, 415 aa, Homo sapiens; identical to SEQ ID NO: 68563

SEQ ID NO: 68572 - protein, 435 aa, Homo sapiens; identical to SEQ ID NO: 68566

SEQ ID NO: 68573 - protein, 435 aa, Homo sapiens; identical to SEQ ID NO: 68566

SEQ ID NO: 68574 - protein, 435 aa, Homo sapiens; identical to SEQ ID NO: 68566

SEQ ID NO: 68575 - protein, 353 aa, Homo sapiens; identical to SEQ ID NO: 68545

SEQ ID NO: 68576 - protein, 415 aa, Homo sapiens; identical to SEQ ID NO: 68563

SEQ ID NO: 68577 - protein, 435 aa, Homo sapiens
MREIVHIQAGQCGNQIGAKFWEVISDEHGIDPTGTYHGDSDLQLDRISVYYNEATGGKYVPRAILVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEGGV

SEQ ID NO: 68578 - protein, 353 aa, Homo sapiens; identical to SEQ ID NO: 68545

SEQ ID NO: 68579 - protein, 353 aa, Homo sapiens; identical to SEQ ID NO: 68545

SEQ ID NO: 68580 - protein, 353 aa, Homo sapiens; identical to SEQ ID NO: 68545

SEQ ID NO: 68581 - protein, 415 aa, Homo sapiens; identical to SEQ ID NO: 68563

SEQ ID NO: 68582 - protein, 415 aa, Homo sapiens; identical to SEQ ID NO: 68563

SEQ ID NO: 68583 - protein, 353 aa, Homo sapiens; identical to SEQ ID NO: 68545

SEQ ID NO: 68584 - protein, 453 aa, Homo sapiens
MSIVTVQLGQCGNQIGFEVFDALLSDSHSSQGLCSMRENEAYQASCKERFFSEEENGVPIARAVLVDMEPKVINQMLSKAAQSGQWKYGQHACFCQKQGSGNNWAYGYSVHGPRHEESIMNIIRKEVEKCDSFSGFFIIMSMAGGTGSGLGAFVTQNLEDQYSNSLKMNQIIWPYGTGEVIVQNYNSILTLSHLYRSSDALLLHENDAIHKICAKLMNIKQISFSDINQVLAHQLGSVFQPTYSAESSFHYRRNPLGDLMEHLVPHPEFKMLSVRNIPHMSENSLAYTTFTWAGLLKHLRQMLISNAKMEEGIDRHVWPPLSGLPPLSKMSLNKDLHFNTSIANLVILRGKDVQSADVEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 68585 - protein, 398 aa, Homo sapiens
MSIVTVQLGQCGNQIGFEVFDALLSDSHSSQGLCSMRENEAYQASCKERFFSEEENGVPIARAVLVDMEPKVINQMLSKAAQSGQWKYGQHACFCQKQGSGNNWAYGYSVHGPRHEESIMNIIRKEVEKCDSFSGFFIIMSMAGGTGSGLGAFVTQNLEDQYSNSLKMNQIIWPYGTGEVIVQNYNSILTLSHLYRSSDALLLHENDAIHKICAKLMNIKQISFSDINQVLAHQLGSVFQPTYSAESSFHYRRNPLGIDRHVWPPLSGLPPLSKMSLNKDLHFNTSIANLVILRGKDVQSADVEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 68586 - protein, 199 aa, Homo sapiens
MSIVTVQLGQCGNQIGFEVFDALLSDSHSSQGLCSMRENEAYQASCKERFFSEEENGGIDRHVWPPLSGLPPLSKMSLNKDLHFNTSIANLVILRGKDVQSADVEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 68587 - protein, 351 aa, Homo sapiens
MSIVTVQLGQCGNQIGFEVFDALLSDSHSSQGLCSMRENEAYQASCKERFFSEEENGVPIARAVLVDMEPKVINQMLSKAAQSGQWKYGQHACFCQKQGSGNNWAYGYSVHGPRHEESIMNIIRKEVEKCDSFSGFFIIMSMAGGTGSGLGAFVTQNLEDQYSNSLKMNQIIWPYGTGEVIVQNYNSILTLSHLYRSSDALLLHENDAIHKICAKLMNIKQISFSDINQVLAHQLGSVFQPTYSAESSFHYRRNPLEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 68588 - protein, 396 aa, Homo sapiens
MSIVTVQLGQCGNQIGFEVFDALLSDSHSSQGLCSMRENEAYQASCKERFFSEEENGVPIARAVLVDMEPKVINQMLSKAAQSGQWKYGQHACFCQKQGSGNNWAYGYSVHGPRHEESIMNIIRKEVEKCDSFSGFFIIMSMAGGTGSGLGAFVTQNLEDQYSNSLKMNQIIWPYGTGEVIVQNYNSILTLSHLYRSSDALLLHENDAIHKICAKLMNIKQISFSDINQVLAHQLGSVFQPTYSAESSFHYRRNPLGDLMEHLVPHPEFKMLSVRNIPHMSENSLAYTTFTWAGLLKHLRQMLISNAKMEEGIDRHVWPPLSGLPPLSKMSLNKDLHFNTSIANLVILRGKDVQSADVGKKFRAYIHQYTKFGIEEEDFLDSFTSLEQVVASYCNL

SEQ ID NO: 68589 - protein, 237 aa, Homo sapiens
MNIKQISFSDINQVLAHQLGSVFQPTYSAESSFHYRRNPLGDLMEHLVPHPEFKMLSVRNIPHMSENSLAYTTFTWAGLLKHLRQMLISNAKMEEGIDRHVWPPLSGLPPLSKMSLNKDLHFNTSIANLVILRGKDVQSADVEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 68590 - protein, 125 aa, Homo sapiens
MSIVTVQLGQCGNQIGFEVFDALLSDSHSSQGLCSMRENEAYQASCKERFFSEEENGVPIARAVLVDMEPKVINQMLSKAAQSGQWKYGQHACFCQKQGSGNNWAYGRDKDSACYPDWSGTPGLQ

SEQ ID NO: 68591 - protein, 163 aa, Homo sapiens
MTQSVVVQVGQCGNQIGCCFWDLALREHAAVNQKGIYDEAISSFFRNVDTRVVGDGGSISKGKICSLKARAVLIDMEEGVVNEILQGPLRDVFDTKQLITDISGSGNNWAVGHKVFGSLYQDQILEKFRKSAEHCDCLQCFFIIHSMGGGKIFHSFACNSVKG

SEQ ID NO: 68592 - protein, 206 aa, Homo sapiens
MESDQRKVVGDGGSISKGKICSLKARAVLIDMEEGVVNEILQGPLRDVFDTKQLITDISGSGNNWAVGHKVFGSLYQDQILEKFRKSAEHCDCLQCFFIIHSMGGGTGSGLGTFLLKVLEDEFPEVYRFVTSIYPSGEDDVITSPYNSILAMKELNEHADCVLPIDNQSLFDIISKIDLMVNSGKLGTTVKPKSLVTSSSGALKKQ

SEQ ID NO: 68593 - protein, 475 aa, Homo sapiens
MTQSVVVQVGQCGNQIGCCFWDLALREHAAVNQKGIYDEAISSFFRNVDTRVVGDGGSISKGKICSLKARAVLIDMEEGVVNEILQGPLRDVFDTKQLITDISGSGNNWAVGHKVFGSLYQDQILEKFRKSAEHCDCLQCFFIIHSMGGGTGSGLGTFLLKVLEDEFPEVYRFVTSIYPSGEDDVITSPYNSILAMKELNEHADCVLPIDNQSLFDIISKIDLMVNSGKLGTTVKPKSLVTSSSGALKKQHKKPFDAMNNIVANLLLNLTSSARFEGSLNMDLNEISMNLVPFPQLHYLVSSLTPLYTLTDVNIPPRRLDQMFSDAFSKDHQLLRADPKHSLYLACALMVRGNVQISDLRRNIERLKPSLQFVSWNQEGWKTSLCSVPPVGHSHSLLALANNTCVKPTFMELKERFMRLYKKKAHLHHYLQVEGMEESCFTEAVSSLSALIQEYDQLDATKNMPVQDLPRLSIAM

SEQ ID NO: 68594 - protein, 206 aa, Homo sapiens; identical to SEQ ID NO: 68592

SEQ ID NO: 68595 - protein, 451 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPNQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFERTCRQYDKLRKREAFLEQFRKEDMFKDNFDEMDTSREIVQQLIDEYHAATRPDYISWGTQEQ

SEQ ID NO: 68596 - protein, 451 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPYQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFESSCQQFDKLRKRDAFLEQFRKEDMFKDNFDEMDRSREVVQELIDEYHAATQPDYISWGTQEQ

SEQ ID NO: 68597 - protein, 666 aa, Homo sapiens; identical to SEQ ID NO: 68504

SEQ ID NO: 68598 - protein, 342 aa, Homo sapiens
MVVVEQIKSQKIHGCQILETVYKHSCGGLPPVRSALEKILAVCHGVMYKQLSAWMLHGLLLDQHEEFFIKQGPSSGNVSAQPEEDEEDLGIGGLTGKQLRELQDLRLIEEENMLAPSLKQFSLRVEILPSYIPVRVAEKILFVGESVQMFENQNVNLTRKGSILKNQEDTFAAELHRLKQQPLFSLVDFEQVVDRIRSTVAEHLWKLMVEESDLLGQLKIIKDFYLLGRGELFQAFIDTAQHMLKTPPTAVTEHDVNVAFQQSAHKVLLDDDNLLPLLHLTIEYHGKEHKADATQAREGPSRETSPREAPASGWAALGLSYKVQWPLHILFTPAVLEKNRQF

SEQ ID NO: 68599 - protein, 1024 aa, Homo sapiens
MARHGPPWSRLDAQQERDVRELVRGVAGLQDEADPNFQLALNFAWSNFRFHRFLDVNSHKIEKTIEGIYEKFVIHSDLSKAASWKRLTEEFLNAPLPSIKEIKTDAHYSILSLLLCLSDSPSNSSYVETPRNKEVEKKDDFDWGKYLMEDEEMDIGPYMDTPNWSEESEEENDQQPLSREDSGIQVDRTPLEEQDQNRKLDPCISWKDEPDDRSWLEHHVVHQYWTARPSQFPHSLHLHSNLAAVWDQHLYSSDPLYVPDDRVLVTETQVIRETLWLLSGVKKLFIFQLIDGKVTVRNNIIVTHLTHSCLRSVLEQIAAYGQVVFRLQEFIDEVMGHSSESMLPGSGSVPKKSTEAPFRTYQAFMWALYKYFISFKEELAEIEKCIINNDTTITLAIVVDKLAPRLSQLKVLHKVFSTGVAEVPPDTRNVVRASHLLNTLYKAILEYDNVGEASEQTVSLLFSLWVETVRPYLQTVDEWIVHGHLWDGAREFIIQRNKNVPVNHRDFWYATYTLYSVSEKTENEEKMSDNASASSGSDQGPSSRQHTMVSFLKPVLKQIIMAGKSMQLLKNLQCAESTTCQAGARDAERKSLYTLFLESVQSRLRHGEDSTPQVLTEQQATKENLMKMQSIAESHLELDDVHDPLLAINFARMYLEQSDFHEKFAGGDVCVDRSSESVTCQTFELTLRSCLYPHIDKQYLDCCGNLMQTLKKDYRLVEYLQAMRNFFLMEGGDTMYDFYTSIFDKIREKETWQNVSFLNVQLQEAVGQRYPEDSSRLSISFENVDTAKKKLPVHILDGLTLSYKVPWPVDIVISLECQKIYNQVFLLLLQIKWAKYSLDVLLFGELVSTAEKPRLKEGLIHEQDTVAQFGPQKEPVRQQIHRMFLLRVKLMHFVNSLHNYIMTRILHSTGLEFQHQVEEAKDLDQLIKIHYRYLSTIHDRCLLREKVSFVKEAIMKVLNLALMFADGWQAGLGTWRMESIEKMESDFKNCHMFLVTILNKAVCRGSFPHLESLALSLMAGMEQS

SEQ ID NO: 68600 - protein, 1024 aa, Homo sapiens
MARHGPPWSRLDAQQERDVRELVRGVAGLQDEADPNFQLALNFAWSNFRFHRFLDVNSHKIEKTIEGIYEKFVIHSDLSKAASWKRLTEEFLNAPLPSIKEIKTDAHYSILSLLLCLSDSPSNSSYVETPRNKEVEKKDDFDWGKYLMEDEEMDIGPYMDTPNWSEESEEENDQQPLSREDSGIQVDRTPLEEQDQNRKLDPCISWKDEPDDRSWLEHHVVHQYWTARPSQFPHSLHLHSNLAAVWDQHLYSSDPLYVPDDRVLVTETQVIRETLWLLSGVKKLFIFQLIDGKVTVRNNIIVTHLTHSCLRSVLEQIAAYGQVVFRLQEFIDEVMGHSSESMLPGSGSVPKKSTEAPFRTYQAFMWALYKYFISFKEELAEIEKCIINNDTTITLAIVVDKLAPRLSQLKVLHKVFSTGVAEVPPDTRNVVRASHLLNTLYKAILEYDNVGEASEQTVSLLFSLWVETVRPYLQTVDEWIVHGHLWDGAREFIIQRNKNVPVNHRDFWYATYTLYSVSEKTENEEKMSDNASASSGSDQGPSSRQHTMVSFLKPVLKQIIMAGKSMQLLKNLQCAESTTCQAGARDAERKSLYTLFLESVQSRLRHGEDSTPQVLTEQQATKENLMKMQSIAESHLELDDVHDPLLAINFARMYLEQSDFHEKFAGGDVCVDRSSESVTCQTFELTLRSCLYPHIDKQYLDCCGNLMQTLKKDYRLVEYLQAMRNFFLMEGGDTMYDFYTSIFDKIREKETWQNVSFLNVQLQEAVGQRYPEDSSRLSISFENVDTAKKKLPVHILDGLTLSYKVPWPVDIVISLECQKIYNQVFLLLLQIKWAKYSLDVLLFGELVSTAEKPRLKEGLIHEQDTVAQFGPQKEPVRQQIHRMFLLRVKLMHFVNSLHNYIMTRILHSTGLEFQHQVEEAKDLDQLIKIHYRYLSTIHDRCLLREKVSFVKEAIMKVLNLALMFADGWQAGLGTWRMESIEKMESDFKNCHMFLVTILNKAVCRGSFPHCEYIMLKYFYLCISL

SEQ ID NO: 68601 - protein, 476 aa, Homo sapiens
MWTGYKILIFSYLTTEIWMEKQYLSQREVDLEAYFTRNHTVLQGTRFKRAIFQGQYCRNFGCCEDRDDGCVTEFYAANALCYCDKFCDRENSDCCPDYKSFCREEKEWPPHTQPWYPEGCFKDGQHYEEGSVIKENCNSCTCSGQQWKCSQHVCLVRSELIEQVNKGDYGWTAQNYSQFWGMTLEDGFKFRLGTLPPSPMLLSMNEMTASLPATTDLPEFFVASYKWPGWTHGPLDQKNCAASWAFSTASVAADRIAIQSKGRYTANLSPQNLISCCAKNRHGCNSGSIDRAWWYLRKRGLVSHACYPLFKDQNATNNGCAMASRSDGRGKRHATKPCPNNVEKSNRIYQCSPPYRVSSNETEIMKEIMQNGPVQAIMQVREDFFHYKTGIYRHVTSTNKESEKYRKLQTHAVKLTGWGTLRGAQGQKEKFWIAANSWGKSWGENGYFRILRGVNESDIEKLIIAAWGQLTSSDEP

SEQ ID NO: 68602 - protein, 335 aa, Homo sapiens
MWTGYKILIFSYLTTEIWMEKQYLSQREVDLEAYFTRNHTVLQGTRFKRAIFQGQYCRNFGCCEDRDDGCVTEFYAANALCYCDKFCDRENSDCCPDYKSFCREEKEWPPHTQPWYPEGRWTAQNYSQFWGMTLEDGFKFRLGTLPPSPMLLSMNEMTRLVSHACYPLFKDQNATNNGCAMASRSDGRGKRHATKPCPNNVEKSNRIYQCSPPYRVSSNETEIMKEIMQNGPVQAIMQVREDFFHYKTGIYRHVTSTNKESEKYRKLQTHAVKLTGWGTLRGAQGQKEKFWIAANSWGKSWGENGYFRILRGVNESDIEKLIIAAWGQLTSSDEP

SEQ ID NO: 68603 - protein, 203 aa, Homo sapiens
MEKQYLSQREVDLEAYFTRNHTVLQGTRFKRAIFQGQYCRNFGCCEDRDDGCVTEFYAANALCYCDKFCDRENSDCCPDYKSFCREEKEWPPHTQPWYPEGCFKDGQHYEEGSVIKENCNSCTCSGQQWKCSQHVCLVRSELIEQVNKGDYGWTAQNYSQFWGMTLEDGFKFRLGTLPPSPMLLSMNEMTVSVPSDSRMCMYL

SEQ ID NO: 68604 - protein, 155 aa, Homo sapiens
MASRSDGRGKRHATKPCPNNVEKSNRIYQCSPPYRVSSNETEIMKEIMQNGPVQAIMQVREDFFHYKTGIYRHVTSTNKESEKYRKLQTHAVKLTGWGTLRGAQGQKEKFWIAANSWGKSWGENGYFRILRGVNESDIEKLIIAAWGQLTSSDEP

SEQ ID NO: 68605 - protein, 205 aa, Homo sapiens
MRAWMFVSMQAEIWMEKQYLSQREVDLEAYFTRNHTVLQGTRFKRAIFQGQYCRNFGCCEDRDDGCVTEFYAANALCYCDKFCDRENSDCCPDYKSFCREEKEWPPHTQPWYPEGCFKDGQHYEEGSVIKENCNSCTCSGQQWKCSQHVCLVRSELIEQVNKGDYGWTAQNYSQFWGMTLEDGFKFRLGTLPPSPMLLSMNEMTE

SEQ ID NO: 68606 - protein, 1189 aa, Homo sapiens
MSVKSPFNVMSRNNLEAPPCKMTEPFNFEKNENKLPPHESLRSPGTLPNHPNFRLKSSENGNKKNNFLLCEQTKQYLASQEDNSVSSNPNGINGEVVGSKGDRKKLPAGNSVSPPSAESNSPPKEVNIKPGNNVRPAKSKKLNKLVENSLSISNPGLFTSLGPPLRSTTCHRCGLFGSLRCSQCKQTYYCSTACQRRDWSAHSIVCRPVQPNFHKLENKSSIETKDVEVNNKSDCPLGVTKEIAIWAERIMFSDLRSLQLKKTMEIKGTVTEFKHPGDFYVQLYSSEVLEYMNQLSASLKETYANVHEKDYIPVKGEVCIAKYTVDQTWNRAIIQNVDVQQKKAHVLYIDYGNEEIIPLNRIYHLNRNIDLFPPCAIKCFVANVIPAEGNWSSDCIKATKPLLMEQYCSIKIVDILEEEVVTFAVEVELPNSGKLLDHVLIEMGYGLKPSGQDSKKENADQSDPEDVGKMTTENNIVVDKSDLIPKVLTLNVGDEFCGVVAHIQTPEDFFCQQLQSGRKLAELQASLSKYCDQLPPRSDFYPAIGDICCAQFSEDDQWYRASVLAYASEESVLVGYVDYGNFEILSLMRLCPIIPKLLELPMQAIKCVLAGVKPSLGIWTPEAICLMKKLVQNKIITVKVVDKLENSSLVELIDKSETPHVSVSKVLLDAGFAVGEQSMVTDKPSDVKETSVPLGVEGKVNPLEWTWVELGVDQTVDVVVCVIYSPGEFYCHVLKEDALKKLNDLNKSLAEHCQQKLPNGFKAEIGQPCCAFFAGDGSWYRALVKEILPNGHVKVHFVDYGNIEEVTADELRMISSTFLNLPFQGIRCQLADIQSRNKHWSEEAITRFQMCVAGIKLQARVVEVTENGIGVELTDLSTCYPRIISDVLIDEHLVLKSASPHKDLPNDRLVNKHELQVHVQGLQATSSAEQWKTIELPVDKTIQANVLEIISPNLFYALPKGMPENQEKLCMLTAELLEYCNAPKSRPPYRPRIGDACCAKYTSDDFWYRAVVLGTSDTDVEVLYADYGNIETLPLCRVQPITSSHLALPFQIIRCSLEGLMELNGSSSQLIIMLLKNFMLNQNVMLSVKGITKNVHTVSVEKCSENGTVDVADKLVTFGLAKNITPQRQSALNTEKMYRMNCCCTELQKQVEKHEHILLFLLNNSTNQNKFIEMKKLLKKTASLGGKPL

SEQ ID NO: 68607 - protein, 1104 aa, Homo sapiens
MSVKSPFNVMSRNNLEAPPCKMTEPFNFEKNENKLPPHESLRSPGTLPNHPNFRLKSSENGNKKNNFLLCEQTKQYLASQEDNSVSSNPNGINGEVVGSKGDRKKLPAGNSVSPPSAESNSPPKEVNIKPGNNVRPAKSKKLNKLVENSLSISNPGLFTSLGPPLRSTTCHRCGLFGSLRCSQCKQTYYCSTACQRRDWSAHSIVCRPVQPNFHKLENKSSIETKDVEVNNKSDCPLGVTKEIAIWAERIMFSDLRSLQLKKTMEIKGTVTEFKHPGDFYVQLYSSEVLEYMNQLSASLKETYANVHEKDYIPVKGEVCIAKYTVDQTWNRAIIQNVDVQQKKAHVLYIDYGNEEIIPLNRIYHLNRNIDLFPPCAIKCFVANVIPAEGNWSSDCIKATKPLLMEQYCSIKIVDILEEEVVTFAVEVELPNSGKLLDHVLIEMGYGLKPSGQDSKKENADQSDPEDVGKMTTENNIVVDKSDLIPKVLTLNVGDEFCGVVAHIQTPEDFFCQQLQSGRKLAELQASLSKYCDQLPPRSDFYPAIGDICCAQFSEDDQWYRASVLAYASEESVLVGYVDYGNFEILSLMRLCPIIPKLLELPMQAIKCVLAGVKPSLGIWTPEAICLMKKLVQNKIITVKVVDKLENSSLVELIDKSETPHVSVSKVLLDAGFAVGEQSMVTDKPSDVKETSVPLGVEGKVNPLEWTWVELGVDQTVDVVVCVIYSPGEFYCHVLKEDALKKLNDLNKSLAEHCQQKLPNGFKAEIGQPCCAFFAGDGSWYRALVKEILPNGHVKVHFVDYGNIEEVTADELRMISSTFLNLPFQGIRCQLADIQSRNKHWSEEAITRFQMCVAGIKLQARVVEVTENGIGVELTDLSTCYPRIISDVLIDEHLVLKSASPHKDLPNDRLVNKHELQVHVQGLQATSSAEQWKTIELPVDKTIQANVLEIISPNLFYALPKGMPENQEKLCMLTAELLEYCNAPKSRPPYRPRIGDACCAKYTSDDFWYRAVVLGTSDTDVEVLYADYGNIETLPLCRVQPITSSHLALPFQIIRCSLEEKMYRMNCCCTELQKQVEKHEHILLFLLNNSTNQNKFIEMKKLLKS

SEQ ID NO: 68608 - protein, 1075 aa, Homo sapiens
MSVKSPFNVMSRNNLEAPPCKMTEPFNFEKNENKLPPHESLRSPGTLPNHPNFRLKSSENGNKKNNFLLCEQTKQYLASQEDNSVSSNPNGINGEVVGSKGDRKKLPAGNSVSPPSAESNSPPKEVNIKPGNNVRPAKSKKLNKLVENSLSISNPGLFTSLGPPLRSTTCHRCGLFGSLRCSQCKQTYYCSTACQRRDWSAHSIVCRPVQPNFHKLENKSSIETKDVEVNNKSDCPLGVTKEIAIWAERIMFSDLRSLQLKKTMEIKGTVTEFKHPGDFYVQLYSSEVLEYMNQLSASLKETYANVHEKDYIPVKGEVCIAKYTVDQTWNRAIIQNVDVQQKKAHVLYIDYGNEEIIPLNRIYHLNRNIDLFPPCAIKCFVANVIPAEGNWSSDCIKATKPLLMEQYCSIKIVDILEEEVVTFAVEVELPNSGKLLDHVLIEMGYGLKPSGQDSKKENADQSDPEDVGKMTTENNIVVDKSDLIPKVLTLNVGDEFCGVVAHIQTPEDFFCQQLQSGRKLAELQASLSKYCDQLPPRSDFYPAIGDICCAQFSGVKPSLGIWTPEAICLMKKLVQNKIITVKVVDKLENSSLVELIDKSETPHVSVSKVLLDAGFAVGEQSMVTDKPSDVKETSVPLGVEGKVNPLEWTWVELGVDQTVDVVVCVIYSPGEFYCHVLKEDALKKLNDLNKSLAEHCQQKLPNGFKAEIGQPCCAFFADIQSRNKHWSEEAITRFQMCVAGIKLQARVVEVTENGIGVELTDLSTCYPRIISDVLIDEHLVLKSASPHKDLPNDRLVNKHELQVHVQGLQATSSAEQWKTIELPVDKTIQANVLEIISPNLFYALPKGMPENQEKLCMLTAELLEYCNAPKSRPPYRPRIGDACCAKYTSDDFWYRAVVLGTSDTDVEVLYADYGNIETLPLCRVQPITSSHLALPFQIIRCSLEGLMELNGSSSQLIIMLLKNFMLNQNVMLSVKGITKNVHTVSVEKCSENGTVDVADKLVTFGLAKNITPQRQSALNTEKMYRMNCCCTELQKQVEKHEHILLFLLNNSTNQNKFIEMKKLLKKTASLGGKPL

SEQ ID NO: 68609 - protein, 1113 aa, Homo sapiens
MSVKSPFNVMSRNNLEAPPCKMTEPFNFEKNENKLPPHESLRSPGTLPNHPNFRLKSSENGNKKNNFLLCEQTKQYLASQEDNSVSSNPNGINGEVVGSKGDRKKLPAGNSVSPPSAESNSPPKEVNIKPGNNVRPAKSKKLNKLVENSLSISNPGLFTSLGPPLRSTTCHRCGLFGSLRCSQCKQTYYCSTACQRRDWSAHSIVCRPVQPNFHKLENKSSIETKDVEVNNKSDCPLGVTKEIAIWAERIMFSDLRSLQLKKTMEIKGTVTEFKHPGDFYVQLYSSEVLEYMNQLSASLKETYANVHEKDYIPVKGEVCIAKYTVDQTWNRAIIQNVDVQQKKAHVLYIDYGNEEIIPLNRIYHLNRNIDLFPPCAIKCFVANVIPAEGNWSSDCIKATKPLLMEQYCSIKIVDILEEEVVTFAVEVELPNSGKLLDHVLIEMGYGLKPSGQDSKKENADQSDPEDVGKMTTENNIVVDKSDLIPKVLTLNVGDEFCGVVAHIQTPEDFFCQQLQSGRKLAELQASLSKYCDQLPPRSDFYPAIGDICCAQFSEDDQWYRASVLAYASEESVLVGYVDYGNFEILSLMRLCPIIPKLLELPMQAIKCVLAGVKPSLGIWTPEAICLMKKLVQNKIITVKVVDKLENSSLVELIDKSETPHVSVSKVLLDAGFAVGEQSMVTDKPSDVKETSVPLGVEGKVNPLEWTWVELGVDQTVDVVVCVIYSPGEFYCHVLKEDALKKLNDLNKSLAEHCQQKLPNGFKAEIGQPCCAFFAGDGSWYRALVKEILPNGHVKVHFVDYGNIEEVTADELRMISSTFLNLPFQGIRCQLADIQSRNKHWSEEAITRFQMCVAGIKLQARVVEVTENGIGVELTDLSTCYPRIISDVLIDEHLVLKSASPHKDLPNDRLVNKHELQVHVQGLQATSSAEQWKTIELPVDKTIQANVLEIISPNLFYALPKGMPENQEKLCMLTAELLEYCNAPKSRPPYRPRIGDACCAKYTSDDFWYRAVVLGTSDTDVEVLYADYGNIETLPLCRVQPITSSHLALPFQIIRCSLEEKMYRMNCCCTELQKQVEKHEHILLFLLNNSTNQNKFIEMKKLLKKTASLGGKPL

SEQ ID NO: 68610 - protein, 717 aa, Homo sapiens
MNQLSASLKETYANVHEKDYIPVKGEVCIAKYTVDQAIKCFVANVIPAEGNWSSDCIKATKPLLMEQYCSIKIVDILEEEVVTFAVEVELPNSGKLLDHVLIEMGYGLKPSGQDSKKENADQSDPEDVGKMTTENNIVVDKSDLIPKVLTLNVGDEFCGVVAHIQTPEDFFCQQLQSGRKLAELQASLSKYCDQLPPRSDFYPAIGDICCAQFSGVKPSLGIWTPEAICLMKKLVQNKIITVKVVDKLENSSLVELIDKSETPHVSVSKVLLDAGFAVGEQSMVTDKPSDVKETSVPLGVEGKVNPLEWTWVELGVDQTVDVVVCVIYSPGEFYCHVLKEDALKKLNDLNKSLAEHCQQKLPNGFKAEIGQPCCAFFAGDGSWYRALVKEILPNGHVKVHFVDYGNIEEVTADELRMISSTFLNLPFQGIRCQLADIQSRNKHWSEEAITRFQMCVAGIKLQARVVEVTENGIGVELTDLSTCYPRIISDVLIDEHLVLKSASPHKDLPNDRLVNKHELQVHVQGLQATSSAEQWKTIELPVDKTIQANVLEIISPNLFYALPKGMPENQEKLCMLTAELLEYCNAPKSRPPYRPRIGDACCAKYTSDDFWYRAVVLGTSDTDVEVLYADYGNIETLPLCRVQPITSSHLALPFQIIRCSLEEKMYRMNCCCTELQKQVEKHEHILLFLLNNSTNQNKFIEMKKLLKKTASLGGKPL

SEQ ID NO: 68611 - protein, 651 aa, Homo sapiens
MLRLQMTDGHISCTAVEFSYMSKISLNTPPGTKVKLSGIVDIKNGFLLLNDSNTTVLGGEVEHLIEKWELQRSLSKHNRSNIGTEGGPPPFVPFGQKCVSHVQVDSRELDRRKTLQVTMPVKPTNDNDEFEKQRTAAIAEVAKSKETKTFGGGGGGARSNLNMNAAGNRNREVLQKEKSTKSEGKHEGVYRELVDEKALKHITEMGFSKEASRQALMDNGNNLEAALNVLLTSNKQKPVMGPPLRGRGKGRGRIRSEDEEDLGNARPSAPSTLFDFLESKMGTLNVEEPKSQPQQLHQGQYRSSNTEQNGVKDNNHLRHPPRNDTRQPRNEKPPRFQRDSQNSKSVLEGSGLPRNRGSERPSTSSVSEVWAEDRIKCDRPYSRYDRTKDTSYPLGSQHSDGAFKKRDNSMQSRSGKGPSFAEAKENPLPQGSVDYNNQKRGKRESQTSIPDYFYDRKSQTINNEAFSGIKIEKHFNVNTDYQNPVRSNSFIGVPNGEVEMPLKGRRIGPIKPAGPVTAVPCDDKIFYNSGPKRRSGPIKPEKILESSIPMEYAKMWKPGDECFALYWEDNKFYRAEVEALHSSGMTAVVKFIDYGNYEEVLLSNIKPIQTEAWEEEGTYDQTLEFRRGGDGQPRRSTRPTQQFYQPPRARN

SEQ ID NO: 68612 - protein, 651 aa, Homo sapiens; identical to SEQ ID NO: 68611

SEQ ID NO: 68613 - protein, 129 aa, Homo sapiens
MLRLQMTDGHISCTAVEFSYMSKISLNTPPGTKVKLSGIVDIKNGFLLLNDSNTTVLGGEVEHLIEKWELQRSLSKHNRSNIGTEGGPPPFVPFGQKCVSHVQVDSRELDRRKTLQVTMPVKPTNDNDE

SEQ ID NO: 68614 - protein, 651 aa, Homo sapiens; identical to SEQ ID NO: 68611

SEQ ID NO: 68615 - protein, 744 aa, Homo sapiens
MAQVAGAALSQAGWYLSDEGIEACTSSPDKVNVNDIILIALNTDLRTIGKKFLPSDINSGKVEKLEGPCVLQIQKIRNVAAPKDNEESQAAPRMLRLQMTDGHISCTAVEFSYMSKISLNTPPGTKVKLSGIVDIKNGFLLLNDSNTTVLGGEVEHLIEKWELQRSLSKHNRSNIGTEGGPPPFVPFGQKCVSHVQVDSRELDRRKTLQVTMPVKPTNDNDEFEKQRTAAIAEVAKSKETKTFGGGGGGARSNLNMNAAGNRNREVLQKEKSTKSEGKHEGVYRELVDEKALKHITEMGFSKEASRQALMDNGNNLEAALNVLLTSNKQKPVMGPPLRGRGKGRGRIRSEDEEDLGNARPSAPSTLFDFLESKMGTLNVEEPKSQPQQLHQGQYRSSNTEQNGVKDNNHLRHPPRNDTRQPRNEKPPRFQRDSQNSKSVLEGSGLPRNRGSERPSTSSVSEVWAEDRIKCDRPYSRYDRTKDTSYPLGSQHSDGAFKKRDNSMQSRSGKGPSFAEAKENPLPQGSVDYNNQKRGKRESQTSIPDYFYDRKSQTINNEAFSGIKIEKHFNVNTDYQNPVRSNSFIGVPNGEVEMPLKGRRIGPIKPAGPVTAVPCDDKIFYNSGPKRRSGPIKPEKILESSIPMEYAKMWKPGDECFALYWEDNKFYRAEVEALHSSGMTAVVKFIDYGNYEEVLLSNIKPIQTEAWEEEGTYDQTLEFRRGGDGQPRRSTRPTQQFYQPPRARN

SEQ ID NO: 68616 - protein, 1098 aa, Homo sapiens
MLEGDLVSKMLRAVLQSHKNGVALPRLQGEYRSLTGDWIPFKQLGFPTLEAYLRSVPAVVRIETSRSGEITCYAMACTETARIAQLVARQRSSKRKTGRQVNCQMRVKKTMPFFLEGKPKATLRQPGFASNFSVGKKPNPAPLRDKGNSVGVKPDAEMSPYMLHTTLGNEAFKDIPVQRHVTMSTNNRFSPKASLQPPLQMHLSRTSTKEMSDNLNQTVEKPNVKPPASYTYKMDEVQNRIKEILNKHNNGIWISKLPHFYKELYKEDLNQGILQQFEHWPHICTVEKPCSGGQDLLLYPAKRKQLLRSELDTEKVPLSPLPGPKQTPPLKGCPTVMAGDFKEKVADLLVKYTSGLWASALPKAFEEMYKVKFPEDALKNLASLSDVCSIDYISGNPQKAILYAKLPLPTDKIQKDAGQAHGDNDIKAMVEQEYLQVEESIAESANTFMEDITVPPLMIPTEASPSVLVVELSNTNEVVIRYVGKDYSAAQELMEDEMKEYYSKNPKITPVQAVNVGQLLAVNAEEDAWLRAQVISTEENKIKVCYVDYGFSENVEKSKAYKLNPKFCSLSFQATKCKLAGLEVLSDDPDLVKVVESLTCGKIFAVEILDKADIPLVVLYDTSGEDDININATCLKAICDKSLEVHLQVDAMYTNVKVTNICSDGTLYCQVPCKGLNKLSDLLRKIEDYFHCKHMTSECFVSLPFCGKICLFHCKGKWLRVEITNVHSSRALDVQFLDSGTVTSVKVSELREIPPRFLQEMIAIPPQAIKCCLADLPQSIGMWTPDAVLWLRDSVLNCSDCSIKVTKVDETRGIAHVYLFTPKNFPDPHRSINRQITNADLWKHQKDVFLSAISSGADSPNSKNGNMPMSGNTGENFRKNLTDVIKKSMVDHTSAFSTEELPPPVHLSKPGEHMDVYVPVACHPGYFVIQPWQEIHKLEVLMEEMILYYSVSEERHIAVEKDQVYAAKVENKWHRVLLKGILTNGLVSVYELDYGKHELVNIRKVQPLVDMFRKLPFQAVTAQLAGVKCNQWSEEASMVFRNHVEKKPLVALVQTVIENANPWDRKVVVYLVDTSLPDTDTWIHDFMSEYLIELSKVN

SEQ ID NO: 68617 - protein, 1024 aa, Homo sapiens
MACTETARIAQLVARQRSSKRKTGRQVNCQMRVKKTMPFFLEGKPKATLRQPGFASNFSVGKKPNPAPLRDKGNSVGVKPDAEMSPYMLHTTLGNEAFKDIPVQRHVTMSTNNRFSPKASLQPPLQMHLSRTSTKEMSDNLNQTVEKPNVKPPASYTYKMDEVQNRIKEILNKHNNGIWISKLPHFYKELYKEDLNQGILQQFEHWPHICTVEKPCSGGQDLLLYPAKRKQLLRSELDTEKVPLSPLPGPKQTPPLKGCPTVMAGDFKEKVADLLVKYTSGLWASALPKAFEEMYKVKFPEDALKNLASLSDVCSIDYISGNPQKAILYAKLPLPTDKIQKDAGQAHGDNDIKAMVEQEYLQVEESIAESANTFMEDITVPPLMIPTEASPSVLVVELSNTNEVVIRYVGKDYSAAQELMEDEMKEYYSKNPKITPVQAVNVGQLLAVNAEEDAWLRAQVISTEENKIKVCYVDYGFSENVEKSKAYKLNPKFCSLSFQATKCKLAGLEVLSDDPDLVKVVESLTCGKIFAVEILDKADIPLVVLYDTSGEDDININATCLKAICDKSLEVHLQVDAMYTNVKVTNICSDGTLYCQVPCKGLNKLSDLLRKIEDYFHCKHMTSECFVSLPFCGKICLFHCKGKWLRVEITNVHSSRALDVQFLDSGTVTSVKVSELREIPPRFLQEMIAIPPQAIKCCLADLPQSIGMWTPDAVLWLRDSVLNCSDCSIKVTKVDETRGIAHVYLFTPKNFPDPHRSINRQITNADLWKHQKDVFLSAISSGADSPNSKNGNMPMSGNTGENFRKNLTDVIKKSMVDHTSAFSTEELPPPVHLSKPGEHMDVYVPVACHPGYFVIQPWQEIHKLEVLMEEMILYYSVSEERHIAVEKDQVYAAKVENKWHRVLLKGILTNGLVSVYELDYGKHELVNIRKVQPLVDMFRKLPFQAVTAQLAGVKCNQWSEEASMVFRNHVEKKPLVALVQTVIENANPWDRKVVVYLVDTSLPDTDTWIHDFMSEYLIELSKVN

SEQ ID NO: 68618 - protein, 418 aa, Homo sapiens
MYTNVKVTNICSDGTLYCQVPCKGLNKLSDLLRKIEDYFHCKITNVHSSRALDVQFLDSGTVTSVKVSELREIPPRFLQEMIAIPPQAIKCCLADLPQSIGMWTPDAVLWLRDSVLNCSDCSIKVTKVDETRGIAHVYLFTPKNFPDPHRSINRQITNADLWKHQKDVFLSAISSGADSPNSKNGNMPMSGNTGENFRKNLTDVIKKSMVDHTSAFSTEELPPPVHLSKPGEHMDVYVPVACHPGYFVIQPWQEIHKLEVLMEEMILYYSVSEERHIAVEKDQVYAAKVENKWHRVLLKGILTNGLVSVYELDYGKHELVNIRKVQPLVDMFRKLPFQAVTAQLAGVKCNQWSEEASMVFRNHVEKKPLVALVQTVIENANPWDRKVVVYLVDTSLPDTDTWIHDFMSEYLIELSKVN

SEQ ID NO: 68619 - protein, 837 aa, Homo sapiens
MSLSHLYRDGEGRIDDDDDERENFEITDWDLQNEFNPNRQRHWQTKEEATYGVWAERDSDDERPSFGGKRARDYSAPVNFISAGLKKGAAEEAELEDSDDEEKPVKQDDFPKDFGPRKLKTGGNFKPSQKGFAGGTKSFMDFGSWERHTKGIGQKLLQKMGYVPGRGLGKNAQGIINPIEAKQRKGKGAVGAYGSERTTQSMQDFPVVDSEEEAEEEFQKELSQWRKDPSGSKKKPKYSYKTVEELKAKGRISKKLTAPQKELSQVKVIDMTGREQKVYYSYSQISHKHNVPDDGLPLQSQQLPQSGKEAKAPGFALPELEHNLQLLIDLTEQEIIQNDRQLQYERDMVVNLFHELEKMTEVLDHEERVISNLSKVLEMVEECERRMQPDCSNPLTLDECARIFETLQDKYYEEYRMSDRVDLAVAIVYPLMKEYFKEWDPLKDCTYGTEIISKWKSLLENDQLLSHGGQDLSADAFHRLIWEVWMPFVRNIVTQWQPRNCDPMVDFLDSWVHIIPVWILDNILDQLIFPKLQKEVENWNPLTDTVPIHSWIHPWLPLMQARLEPLYSPIRSKLSSALQKWHPSDSSAKLILQPWKDVFTPGSWEAFMVKNIVPKLGMCLGELVINPHQQHMDAFYWVIDWEGMISVSSLVGLLEKHFFPKWLQVLCSWLSNSPNYEEITKWYLGWKSMFSDQVLAHPSVKDKFNEALDIMNRAVSSNVGAYMQPGARENIAYLTHTERRKDFQYEAMQERREAENMAQRGIGVAASSVPMNFKDLIETKAEEHNIVFMPVIGKRHEGKQLYTFGRIVIYIDRGVVFVQGEKTWVPTSLQSLIDMAK

SEQ ID NO: 68620 - protein, 837 aa, Homo sapiens; identical to SEQ ID NO: 68619

SEQ ID NO: 68621 - protein, 837 aa, Homo sapiens; identical to SEQ ID NO: 68619

SEQ ID NO: 68622 - protein, 837 aa, Homo sapiens; identical to SEQ ID NO: 68619

SEQ ID NO: 68623 - protein, 88 aa, Homo sapiens
MSLSHLYRDGEGRIDDDDDERENFEITDWDLQNEFNPNRQRHWQTKEEATYGVWAERDSDDERPSFGGKRARDYSAPVNFISAGLKKG

SEQ ID NO: 68624 - protein, 86 aa, Homo sapiens
MSLSHLYRDGEGRIDDDDDERENFEITDWDLQNEFNPNRQRHWQTKEEATYGVWAERDSDDERPSFGGKRARDYSAPVNFISAGLK

SEQ ID NO: 68625 - protein, 42 aa, Homo sapiens
MSLSHLYRDGEGRIDDDDDERENFEITDWDLQNEFNPNRQRH

SEQ ID NO: 68626 - protein, 522 aa, Homo sapiens
MSLSHLYRDGEGRIDDDDDERENFEITDWDLQNEFNLFHELEKMTEVLDHEERVISNLSKVLEMVEECERRMQPDCSNPLTLDECARIFETLQDKYYEEYRMSDRVDLAVAIVYPLMKEYFKEWDPLKDCTYGTEIISKWKSLLENDQLLSHGGQDLSADAFHRLIWEVWMPFVRNIVTQWQPRNCDPMVDFLDSWVHIIPVWILDNILDQLIFPKLQKEVENWNPLTDTVPIHSWIHPWLPLMQARLEPLYSPIRSKLSSALQKWHPSDSSAKLILQPWKDVFTPGSWEAFMVKNIVPKLGMCLGELVINPHQQHMDAFYWVIDWEGMISVSSLVGLLEKHFFPKWLQVLCSWLSNSPNYEEITKWYLGWKSMFSDQVLAHPSVKDKFNEALDIMNRAVSSNVGAYMQPGARENIAYLTHTERRKDFQYEAMQERREAENMAQRGIGVAASSVPMNFKDLIETKAEEHNIVFMPVIGKRHEGKQLYTFGRIVIYIDRGVVFVQGEKTWVPTSLQSLIDMAK

SEQ ID NO: 68627 - protein, 191 aa, Homo sapiens
  MOD_RES (1)..(1): Any amino acid
XGRGLGKNAQGIINPIEAKQRKGKGAVGAYGSERTTQSMQDFPVVDSEEEAEEWLFLAASDCILLVQEFQKELSQWRKDPSGSKKKPKYSYKTVEELKAKGRISKKLTAPQKELSQVKVIDMTGREQKVYYSYSQISHKHNVPDDGLPLQSQQLPQSGKEAKAPGFALPELEHNLQLLIDLTEQEIIQNDR

SEQ ID NO: 68628 - protein, 121 aa, Homo sapiens
MSLSHLYRDGEGRIDDDDDERENFEITDWDLQNEFNPNRQRHWQTKEEATYGVWAERDSDDERPSFGGKRARDYSAPVNFISAGLKKGAAEEAELEDSDDEEKPVKQDDFPKDFGPRKLKT

SEQ ID NO: 68629 - protein, 240 aa, Homo sapiens
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 68630 - protein, 317 aa, Homo sapiens
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 68631 - protein, 244 aa, Homo sapiens
MDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 68632 - protein, 244 aa, Homo sapiens; identical to SEQ ID NO: 68631

SEQ ID NO: 68633 - protein, 244 aa, Homo sapiens; identical to SEQ ID NO: 68631

SEQ ID NO: 68634 - protein, 244 aa, Homo sapiens; identical to SEQ ID NO: 68631

SEQ ID NO: 68635 - protein, 249 aa, Homo sapiens
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 68636 - protein, 330 aa, Homo sapiens
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 68637 - protein, 240 aa, Homo sapiens; identical to SEQ ID NO: 68629

SEQ ID NO: 68638 - protein, 204 aa, Homo sapiens
MEESVVRPSVFVVDGQTDIPFTRLGRSHRRQSCSVARDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 68639 - protein, 174 aa, Homo sapiens
MRHFLSKVYSFPMRKLILFLVFPVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 68640 - protein, 251 aa, Homo sapiens
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 68641 - protein, 177 aa, Homo sapiens
MCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 68642 - protein, 199 aa, Homo sapiens
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 68643 - protein, 183 aa, Homo sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 68644 - protein, 133 aa, Homo sapiens
MVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 68645 - protein, 133 aa, Homo sapiens; identical to SEQ ID NO: 68644

SEQ ID NO: 68646 - protein, 254 aa, Homo sapiens
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 68647 - protein, 616 aa, Homo sapiens
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKESSGDSCVSTHTANFGQQGACEGVLLLTLEEKTFPEDMCYPDQGGVCQGTCVGGGPYAQGEDARMLSLVSKTEIEEDSFRQMPTEDEYMDRPSQPTDQLLFLTEPGSKSTPPFSEPLEVGENDSLSQCFTGTQSTVGSESCNCTEPLCRTDWTPMSSENYLQKEVDSGHCPHWAASPSPNWADVCTGCRNPPGEDCEPLVGSPKRGPLPQCAYGMGLPPEEEASRTEARDQPEDGADGRLPSSARAGAGSGSSPGGQSPASGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 68648 - protein, 259 aa, Homo sapiens
MARIPKTLKFVVVIVAVLLPVLAYSATTARQEEVPQQTVAPQQQRHSFKGEECPAGSHRSEHTGACNPCTEGVDYTNASNNEPSCFPCTVCKSDQKHKSSCTMTRDTVCQCKEGTFRNENSPEMCRKCSRCPSGEVQVSNCTSWDDIQCVEEFGANATVETPAAEETMNTSPGTPAPAAEETMNTSPGTPAPAAEETMTTSPGTPAPAAEETMTTSPGTPAPAAEETMITSPGTPASSHYLSCTIVGIIVLIVLLIVFV

SEQ ID NO: 68649 - protein, 157 aa, Homo sapiens
MTRDTVCQCKEGTFRNENSPEMCRKCSRCPSGEVQVSNCTSWDDIQCVEEFGANATVETPAAEETMNTSPGTPAPAAEETMNTSPGTPAPAAEETMTTSPGTPAPAAEETMTTSPGTPAPAAEETMITSPGTPASSHYLSCTIVGIIVLIVLLIVFV

SEQ ID NO: 68650 - protein, 277 aa, Homo sapiens
MARIPKTLKFVVVIVAVLLPVLAYSATTARQEEVPQQTVAPQQQRHSFKGEECPAGSHRSEHTGACNPCTEGVDYTNASNNEPSCFPCTVCKSDQKHKSSCTMTRDTVCQCKEGTFRNENSPEMCRKCSRCPSGEVQVSNCTSWDDIQCVEEFGANATVETPAAEETMNTSPGTPAPAAEETMNTSPGTPAPAAEETMTTSPGTPAPAAEETMTTSPGTPAPAAEETMITSPGTPASSHYLSCTIVGIIVLIVLLIVPYLKKKKKKKLKKKQKRKSK

SEQ ID NO: 68651 - protein, 616 aa, Homo sapiens; identical to SEQ ID NO: 68647

SEQ ID NO: 68652 - protein, 321 aa, Homo sapiens
GSRARWATEAAEAAAPASLSRAMAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 68653 - protein, 401 aa, Homo sapiens
MNNLLCCALVFLDISIKWTTQETFPPKYLHYDEETSHQLLCDKCPPGTYLKQHCTAKWKTVCAPCPDHYYTDSWHTSDECLYCSPVCKELQYVKQECNRTHNRVCECKEGRYLEIEFCLKHRSCPPGFGVVQAGTPERNTVCKRCPDGFFSNETSSKAPCRKHTNCSVFGLLLTQKGNATHDNICSGNSESTQKCGIDVTLCEEAFFRFAVPTKFTPNWLSVLVDNLPGTKVNAESVERIKRQHSSQEQTFQLLKLWKHQNKDQDIVKKIIQDIDLCENSVQRHIGHANLTFEQLRSLMESLPGKKVGAEDIEKTIKACKPSDQILKLLSLWRIKNGDQDTLKGLMHALKHSKTYHFPKTVTQSLKKTIRFLHSFTMYKLYQKLFLEMIGNQVQSVKISCL

SEQ ID NO: 68654 - protein, 129 aa, Homo sapiens
MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRREKFTTPIEETGGEGCPAVALIQ

SEQ ID NO: 68655 - protein, 94 aa, Homo sapiens
MARGSLRRLLRLLVLGLWLALLRSVAGEQAPGAAAPPAPFRLLWPILGGALSLTFVLGLLSGFLVWRRCRRREKFTTPIEETGGEGCPAVALIQ

SEQ ID NO: 68656 - protein, 293 aa, Homo sapiens
MSGLGRSRRGGRSRVDQEERFPQGLWTGVAMRSCPEEQYWDPLLGTCMSCKTICNHQSQRTCAAFCRSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRWGCHTRTTVLQPCPHIPDSGLGIVCVPAQEGGPGA

SEQ ID NO: 68657 - protein, 248 aa, Homo sapiens
MSGLGRSRRGGRSRVDQEERWSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRKTKPPPVLTAGNCGVHRPPPETSTGSPRGQRLLWTQ

SEQ ID NO: 68658 - protein, 184 aa, Homo sapiens
MRRGPRSLRGRDAPAPTPCVPAECFDLLVRHCVACGLLRTPRPKPAGASSPAPRTALQPQESVGAGAGEAALPLPGLLFGAPALLGLALVLALVLVGLVSWRRRQRRLRGASSAEAPDGDKDAPEPLDKVIILSPGISDATAPAWPPPGEDPGTTPPGHSVPVPATELGSTELVTTKTAGPEQQ

SEQ ID NO: 68659 - protein, 283 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 68660 - protein, 173 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPDIGSPCDLRGRGHLEAGAHLSPGRQKGEPDPEVAFESLSAEPHARLSMASAPCGQAGLHLRDRADGTPGGRA

SEQ ID NO: 68661 - protein, 183 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQT

SEQ ID NO: 68662 - protein, 231 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPR

SEQ ID NO: 68663 - protein, 231 aa, Homo sapiens; identical to SEQ ID NO: 68662

SEQ ID NO: 68664 - protein, 231 aa, Homo sapiens; identical to SEQ ID NO: 68662

SEQ ID NO: 68665 - protein, 184 aa, Homo sapiens
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 68666 - protein, 135 aa, Homo sapiens
MLQMAGQCSQNEYFDSLLHACIPCQLRCSSNTPPLTCQRYCNARSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 68667 - protein, 138 aa, Homo sapiens
MAGQCSQNEYFDSLLHACIPCQLRCSSNTPPLTCQRYCNASVTNSVKGTNAILWTCLGLSLIISLAVFVLMFLLRKINSEPLKDEFKNTEMESRSVAQAGVQWRDLNSLQPLPLGFKQFSHLSLLSNWDYRIRSPGHG

SEQ ID NO: 68668 - protein, 255 aa, Homo sapiens
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCCWRCRRRPKTPEAASSPRKSGASDRQRRRGGWETCGCEPGRPPGPPTAASPSPGAPQAAGALRSALGRALLPWQQKWVQEGGSDQRPGPCSSAAAAGPCRRERETQSWPPSSLAGPDGVGS

SEQ ID NO: 68669 - protein, 234 aa, Homo sapiens
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRKTQLLLEVPPSTEDARSCQFPEEERGERSAEEKGRLGDLWV

SEQ ID NO: 68670 - protein, 241 aa, Homo sapiens
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 68671 - protein, 277 aa, Homo sapiens
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 68672 - protein, 132 aa, Homo sapiens
  MOD_RES (1)..(1): Any amino acid
XPGAPPLPPGAQTRPRPRGVGETTLAMWPGLAGLSRSGSERKQLCTATQDTVCRCRAGTQPLDSYKPGVDCAPCPPGHFSPGDNQACKPWTNCTLAGKHTLQPASNSSDAICEDRDPPATQPQETQGPPARP

SEQ ID NO: 68673 - protein, 140 aa, Homo sapiens
MRALEGPGLSLLCLVLALPALLPVPAVRGVAETPTYPWRDAETGERLVCAQCPPGTFVQRPCRRDSPTTCGPCPPRHYTQFWNYLERCRYCNVLCGEREEEARACHATHNRACCGCCRRCAWPGCPGWSGASVSASSLCT

SEQ ID NO: 68674 - protein, 300 aa, Homo sapiens
MRALEGPGLSLLCLVLALPALLPVPAVRGVAETPTYPWRDAETGERLVCAQCPPGTFVQRPCRRDSPTTCGPCPPRHYTQFWNYLERCRYCNVLCGEREEEARACHATHNRACRCRTGFFAHAGFCLEHASCPPGAGVIAPGTPSQNTQCQPCPPGTFSASSSSSEQCQPHRNCTALGLALNVPGSSSHDTLCTSCTGFPLSTRVPGAEECERAVIDFVAFQDISIKRLQRLLQALEAPEGWGPTPRAGRAALQLKLRRRLTELLGAQDGALLVRLLQALRVARMPGLERSVRERFLPVH

SEQ ID NO: 68675 - protein, 300 aa, Homo sapiens; identical to SEQ ID NO: 68674

SEQ ID NO: 68676 - protein, 595 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSRARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 68677 - protein, 132 aa, Homo sapiens
MSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 68678 - protein, 483 aa, Homo sapiens
MFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSRARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 68679 - protein, 316 aa, Homo sapiens
MSGDTCLCPASGAKPKLSGFKGGGLGNKYVQLNVGGSLYYTTVRALTRHDTMLKAMFSGRMEVLTDKEGWILIDRCGKHFGTILNYLRDDTITLPQNRQEIKELMAEAKYYLIQGLVNMCQSALQDKKDSYQPVCNIPIITSLKEEERLIESSTKPVVKLLYNRSNNKYSYTSNSDDHLLKNIELFDKLSLRFNGRVLFIKDVIGDEICCWSFYGQGRKLAEVCCTSIVYATEKKQTKVEFPEARIYEETLNVLLYETPRVPDNSLLEATSRSRSQASPSEDEETFELRDRVRRIHVKRYSTYDDRQLGHQSTHRD

SEQ ID NO: 68680 - protein, 212 aa, Homo sapiens
MAEAKYYLIQGLVNMCQSALQDKKDSYQPVCNIPIITSLKEEERLIESSTKPVVKLLYNRSNNKYSYTSNSDDHLLKNIELFDKLSLRFNGRVLFIKDVIGDEICCWSFYGQGRKLAEVCCTSIVYATEKKQTKVEFPEARIYEETLNVLLYETPRVPDNSLLEATSRSRSQASPSEDEETFELRDRVRRIHVKRYSTYDDRQLGHQSTHRD

SEQ ID NO: 68681 - protein, 654 aa, Homo sapiens
MSEASSEDLVPPLEAGAAPYREEEEAAKKKKEKKKKSKGLANVFCVFTKGKKKKGQPSSAEPEDAAGSRQGLDGPPPTVEELKAALERGQLEAARPLLALERELAAAAAAGGVSEEELVRRQSKVEALYELLRDQVLGVLRRPLEAPPERLRQALAVVAEQEREDRQAAAAGPGTSGLAATRPRRWLQLWRRGVAEAAEERMGQRPAAGAEVPESVFLHLGRTMKEDLEAVVERLKPLFPAEFGVVAAYAESYHQHFAAHLAAVAQFELCERDTYMLLLWVQNLYPNDIINSPKLVGELQGMGLGSLLPPRQIRLLEATFLSSEAANVRELMDRALELEARRWAEDVPPQRLDGHCHSELAIDIIQITSQAQAKAESITLDLGSQIKRVLLVELPAFLRSYQRAFNEFLERGKQLTNYRANVIANINNCLSFRMSMEQNWQVPQDTLSLLLGPLGELKSHGFDTLLQNLHEDLKPLFKRFTHTRWAAPVETLENIIATVDTRLPEFSELQGCFREELMEALHLHLVKEYIIQLSKGRLVLKTAEQQQQLAGYILANADTIQHFCTQHGSPATWLQPALPTLAEIIRLQDPSAIKIEVATYATCYPDFSKGHLSAILAIKGNLSNSEVKRIRSILDVSMGAQEPSRPLFSLIKVG

SEQ ID NO: 68682 - protein, 323 aa, Homo sapiens [sequence omitted]

SEQ ID NO: 68683 - protein, 199 aa, Homo sapiens
MEALHLHLVKEYIIQLSKGRLVLKTAEQQQQLAGYILANADTIQHFCTQHGSPATWLQPALPTLAEIIRLQDPSAIKIEVATYATCYPDFSKGHLSAILAIKGNLSNSEVKRIRSILDVSMGAQEPSRPLFSLIKPRAAVSGIQQWWNGRQNWKRKKEKMSSRLAGAFRVLWRAVSTASIRRHIQVAPRPLQAGPAMGP

SEQ ID NO: 68684 - protein, 39 aa, Homo sapiens
MSEASSEDLVPPLEAGAAPYREEEEAAKKKKEKKKKSKG

SEQ ID NO: 68685 - protein, 654 aa, Homo sapiens; identical to SEQ ID NO: 68681

SEQ ID NO: 68686 - protein, 790 aa, Homo sapiens
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKMASTDTPMARSGLQYNSLEEIHIFVLCNILRRPIIVISDKMLRSLESGSNFAPLKVGGIYLPLHWPAQECYRYPIVLGYDSHHFVPLVTLKDSGPEIRAVPLVNRDRGRFEDLKVHFLTDPENEMKEKLLKEYLMVIEIPVQGWDHGTTHLINAAKLDEANLPKEINLVDDYFELVQHEYKKWQENSEQGRREGHAQNPMEPSVPQLSLMDVKCETPNCPFFMSVNTQPLCHECSERRQKNQNKLPKLNSKPGPEGLPGMALGASRGEAYEPLAWNPEESTGGPHSAPPTAPSPFLFSETTAMKCRSPGCPFTLNVQHNGFCERCHNARQLHASHAPDHTRHLDPGKCQACLQDVTRTFNGICSTCFKRTTAEASSSLSTSLPPSCHQRSKSDPSRLVRSPSPHSCHRAGNDAPAGCLSQAARTPGDRTGTSKCRKAGCVYFGTPENKGFCTLCFIEYRENKHFAAASGKVSPTASRFQNTIPCLGRECGTLGSTMFEGYCQKCFIEAQNQRFHEAKRTEEQLRSSQRRDVPRTTQSTSRPKCARASCKNILACRSEELCMECQHPNQRMGPGAHRGEPAPEDPPKQRCRAPACDHFGNAKCNGYCNECFQFKQMYG

SEQ ID NO: 68687 - protein, 162 aa, Homo sapiens
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTR

SEQ ID NO: 68688 - protein, 26 aa, Homo sapiens
MAEQVLPQALYLSNMRKAVKIRERTP

SEQ ID NO: 68689 - protein, 98 aa, Homo sapiens
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTN

SEQ ID NO: 68690 - protein, 270 aa, Homo sapiens
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKMASTDTPMARSGLQYNSLEEIHIFVLCNILRRPIIVISDKMLRSLESGSNFAPLKVGGIYLPLHWPAQECYRYPIVLGYDSHHFVPLVTLKDSGPDI

SEQ ID NO: 68691 - protein, 749 aa, Homo sapiens
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKMASTDTPMARSGLQYNSLEEIHIFVLCNILRRPIIVISDKMLRSLESGSNFAPLKVGGIYLPLHWPAQECYRYPIVLGYDSHHFVPLVTLKDSGPEIRAVPLVNRDRGRFEDLKVHFLTDPENEMKEKLLKEYLMVIEIPVQGWDHGTTHLINAAKLDEANLPKEINLVDDYFELVQHEYKKWQENSEQGRREGHAQNPMEPSVPQLSLMDVKCETPNCPFFMSVNTQPLCHECSERRQKNQNKLPKLNSKPGPEGLPGMALGASRGEAYEPLAWNPEESTGGPHSAPPTAPSPFLFSETTAMKCRSPGCPFTLNVQHNGFCERCHNARQLHASHAPDHTRHLDPGKCQACLQDVTRTFNGICSTCFKRTTAEASSSLSTSLPPSCHQRSKSDPSRLVRSPSPHSCHRAGNDAPAGCLSQAARTPGDRTGTSKCRKAGCVYFGTPENKGFCTLCFIEYRENKHFAAASGKVSPTASRFQNTIPCLGRECGTLGSTMFEGYCQKCFIEAQNQRFHEAKRTEEQLRSSQRRDVPRTTQSTSRPKCARASCKNILACRSEELCMECQHQPEDGPWGPPG

SEQ ID NO: 68692 - protein, 152 aa, Homo sapiens
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESQISGIC

SEQ ID NO: 68693 - protein, 214 aa, Homo sapiens
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKWLPQTHPWPEVDFSTTHWKKYTYLSFATSSEGQSLSFQTKC

SEQ ID NO: 68694 - protein, 669 aa, Homo sapiens
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKMASTDTPMARSGLQYNSLEEIHIFVLCNILRRPIIVISDKMLRSLESGSNFAPLKVGGIYLPLHWPAQECYRYPIVLGYDSHHFVPLVTLKDSGPEIRAVPLVNRDRGRFEDLKVHFLTDPENEMKEKLLKEYLMVIEIPVQGWDHGTTHLINAAKLDEANLPKEINLVDDYFELVQHEYKKWQENSEQGRREGHAQNPMEPSVPQLSLMDVKCETPNCPFFMSVNTQPLCHECSERRQKNQNKLPKLNSKPGPEGLPGMALGASRGEAYEPLAWNPEESTGGPHSAPPTAPSPFLFSETTAMKCRSPGCPFTLNVQHNGFCERCHNARQLHASHAPDHTRHLDPGKCQACLQDVTRTFNGICSTCFKRTTAEASSSLSTSLPPSCHQRSKSDPSRLVRSPSPHSCHRAGNDAPAGCLSQAARTPGDRTGTSKCRKAGCVYFGTPENKGFCTLFHRVQRKQTFCCCLRESQSHSVQVPEHHSVPGEGMRHPWKHHV

SEQ ID NO: 68695 - protein, 277 aa, Homo sapiens
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 68696 - protein, 188 aa, Homo sapiens
MATDVFNSKNLAVQAQKKILGKMVSKSIATTLIDDTSSEVLDELYRVTREYTQNKKEAEKIIKNLIKTVIKLAILYRNNQFNQDELALMEKFKKKVHQLAMTVVSFHQVDYTFDRNVLSRLLNECREMLHQIIQRHLTAKSHGRVNNVFDHFSDCEFLAALYNPFGNFKPHLQKLCDGINKMLDEENI

SEQ ID NO: 68697 - protein, 198 aa, Homo sapiens
MHSEAEESKEVATDVFNSKNLAVQAQKKILGKMVSKSIATTLIDDTSSEVLDELYRVTREYTQNKKEAEKIIKNLIKTVIKLAILYRNNQFNQDELALMEKFKKKVHQLAMTVVSFHQVDYTFDRNVLSRLLNECREMLHQIIQRHLTAKSHGRVNNVFDHFSDCEFLAALYNPFGNFKPHLQKLCDGINKMLDEENI

SEQ ID NO: 68698 - protein, 198 aa, Homo sapiens; identical to SEQ ID NO: 68697

SEQ ID NO: 68699 - protein, 184 aa, Homo sapiens
MESFSSKSLALQAEKKLLSKMAGRSVAHLFIDETSSEVLDELYRVSKEYTHSRPQAQRVIKDLIKVAIKVAVLHRNGSFGPSELALATRFRQKLRQGAMTALSFGEVDFTFEAAVLAGLLTECRDVLLELVEHHLTPKSHGRIRHVFDHFSDPGLLTALYGPDFTQHLGKICDGLRKLLDEGKL

SEQ ID NO: 68700 - protein, 229 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYVKTSEKLGEWNEKVTQSDLYKKTQETLSQAGQKTSAALSTVGSAISRKLGDMRAHPFSHSFSSYSIRHSISMPAMRNSATFKSFEDRVGTIKSKVVGDRENGSDNLPSSAGSGDKPLSDPAPF

SEQ ID NO: 68701 - protein, 206 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYVKTSEKLGEWNEKVTQSDLYKKTQETLSQAGQKTSAALSTVGSAISRKLGDMRNSATFKSFEDRVGTIKSKVVGDRENGSDNLPSSAGSGDKPLSDPAPF

SEQ ID NO: 68702 - protein, 186 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYKKTQETLSQAGQKTSAALSTVGSAISRKLGDMRNSATFKSFEDRVGTIKSKVVGDRENGSDNLPSSAGSGDKPLSDPAPF

SEQ ID NO: 68703 - protein, 209 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYKKTQETLSQAGQKTSAALSTVGSAISRKLGDMRAHPFSHSFSSYSIRHSISMPAMRNSATFKSFEDRVGTIKSKVVGDRENGSDNLPSSAGSGDKPLSDPAPF

SEQ ID NO: 68704 - protein, 220 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYVKTSEKLGEWNEKVTQSDLYKKTQETLSQAGQKTSAALSTVGSAISRKLGDMSSYSIRHSISMPAMRNSATFKSFEDRVGTIKSKVVGDRENGSDNLPSSAGSGDKPLSDPAPF

SEQ ID NO: 68705 - protein, 200 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYKKTQETLSQAGQKTSAALSTVGSAISRKLGDMSSYSIRHSISMPAMRNSATFKSFEDRVGTIKSKVVGDRENGSDNLPSSAGSGDKPLSDPAPF

SEQ ID NO: 68706 - protein, 163 aa, Homo sapiens
MDSAGQGVAARTPAVEGLTEAEEEELRAELTKVEEEIVTLRQVLAAKERHCGELKRRLGLSTLGELKQNLSRSWHDVQVSSAYKKTQETLSQAGQKTSAALSTVGSAISRKLGDMRNSATFKSFEDRVGTIKSKVVGDRENGSDNLPSSAGSGDKPLSDPAPF

SEQ ID NO: 68707 - protein, 1134 aa, Homo sapiens
MRFGSKMMPMFLTVYLSNNEQHFTEVPVTPETICRDVVDLCKEPGESDCHLAEVWCGSERPVADNERMFDVLQRFGSQRNEVRFFLRHERPPGRDIVSGPRSQDPSLKRNGVKVPGEYRRKENGVNSPRMDLTLAELQEMASRQQQQIEAQQQLLATKEQRLKFLKQQDQRQQQQVAEQEKLKRLKEIAENQEAKLKKVRALKGHVEQKRLSNGKLVEEIEQMNNLFQQKQRELVLAVSKVEELTRQLEMLKNGRIDSHHDNQSAVAELDRLYKELQLRNKLNQEQNAKLQQQRECLNKRNSEVAVMDKRVNELRDRLWKKKAALQQKENLPVSSDGNLPQQAASAPSRVAAVGPYIQSSTMPRMPSRPELLVKPALPDGSLVIQASEGPMKIQTLPNMRSGAASQTKGSKIHPVGPDWSPSNADLFPSQGSASVPQSTGNALDQVDDGEVPLREKEKKVRPFSMFDAVDQSNAPPSFGTLRKNQSSEDILRDAQVANKNVAKVPPPVPTKPKQINLPYFGQTNQPPSDIKPDGSSQQLSTVVPSMGTKPKPAGQQPRVLLSPSIPSVGQDQTLSPGSKQESPPAAAVRPFTPQPSKDTLLPPFRKPQTVAASSIYSMYTQQQAPGKNFQQAVQSALTKTHTRGPHFSSVYGKPVIAAAQNQQQHPENIYSNSQGKPGSPEPETEPVSSVQENHENERIPRPLSPTKLLPFLSNPYRNQSDADLEALRKKLSNAPRPLKKRSSITEPEGPNGPNIQKLLYQRTTIAAMETISVPSYPSKSASVTASSESPVEIQNPYLHVEPEKEVVSLVPESLSPEDVGNASTENSDMPAPSPGLDYEPEGVPDNSPNLQNNPEEPNPEAPHVLDVYLEEYPPYPPPPYPSGEPEGPGEDSVSMRPPEITGQVSLPPGKRTNLRKTGSERIAHGMRVKFNPLALLLDSSLEGEFDLVQRIIYEVDDPSLPNDEGITALHNAVCAGHTEIVKFLVQFGVNVNAADSDGWTPLHCAASCNNVQVCKFLVESGAAVFAMTYSDMQTAADKCEEMEEGYTQCSQFLYGVQEKMGIMNKGVIYALWDYEPQNDDELPMKEGDCMTIIHREDEDEIEWWWARLNDKEGYVPRNLLGLYPRIKPRQRSLA

SEQ ID NO: 68708 - protein, 1005 aa, Homo sapiens
MDLTLAELQEMASRQQQQIEAQQQLLATKEQRLKFLKQQDQRQQQQVAEQEKLKRLKEIAENQEAKLKKVRALKGHVEQKRLSNGKLVEEIEQMNNLFQQKQRELVLAVSKVEELTRQLEMLKNGRIDSHHDNQSAVAELDRLYKELQLRNKLNQEQNAKLQQQRECLNKRNSEVAVMDKRVNELRDRLWKKKAALQQKENLPVSSDGNLPQQAASAPSRVAAVGPYIQSSTMPRMPSRPELLVKPALPDGSLVIQASEGPMKIQTLPNMRSGAASQTKGSKIHPVGPDWSPSNADLFPSQGSASVPQSTGNALDQVDDGEVPLREKEKKVRPFSMFDAVDQSNAPPSFGTLRKNQSSEDILRDAQVANKNVAKVPPPVPTKPKQINLPYFGQTNQPPSDIKPDGSSQQLSTVVPSMGTKPKPAGQQPRVLLSPSIPSVGQDQTLSPGSKQESPPAAAVRPFTPQPSKDTLLPPFRKPQTVAASSIYSMYTQQQAPGKNFQQAVQSALTKTHTRGPHFSSVYGKPVIAAAQNQQQHPENIYSNSQGKPGSPEPETEPVSSVQENHENERIPRPLSPTKLLPFLSNPYRNQSDADLEALRKKLSNAPRPLKKRSSITEPEGPNGPNIQKLLYQRTTIAAMETISVPSYPSKSASVTASSESPVEIQNPYLHVEPEKEVVSLVPESLSPEDVGNASTENSDMPAPSPGLDYEPEGVPDNSPNLQNNPEEPNPEAPHVLDVYLEEYPPYPPPPYPSGEPEGPGEDSVSMRPPEITGQVSLPPGKRTNLRKTGSERIAHGMRVKFNPLALLLDSSLEGEFDLVQRIIYEVDDPSLPNDEGITALHNAVCAGHTEIVKFLVQFGVNVNAADSDGWTPLHCAASCNNVQVCKFLVESGAAVFAMTYSDMQTAADKCEEMEEGYTQCSQFLYGVQEKMGIMNKGVIYALWDYEPQNDDELPMKEGDCMTIIHREDEDEIEWWWARLNDKEGYVPRNLLGLYPRIKPRQRSLA

SEQ ID NO: 68709 - protein, 367 aa, Homo sapiens
METISVPSYPSKSASVTASSESPVEIQNPYLHVEPEKEVVSLVPESLSPEDVGNASTENSDMPAPSPGLDYEPEGVPDNSPNLQNNPEEPNPEAPHVLDVYLEEYPPYPPPPYPSGEPEGPGEDSVSMRPPEITGQVSLPPGKRTNLRKTGSERIAHGMRVKFNPLALLLDSSLEGEFDLVQRIIYEVDDPSLPNDEGITALHNAVCAGHTEIVKFLVQFGVNVNAADSDGWTPLHCAASCNNVQVCKFLVESGAAVFAMTYSDMQTAADKCEEMEEGYTQCSQFLYGVQEKMGIMNKGVIYALWDYEPQNDDELPMKEGDCMTIIHREDEDEIEWWWARLNDKEGYVPRNLLGLYPRIKPRQRSLA

SEQ ID NO: 68710 - protein, 680 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 68711 - protein, 510 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANRSGKSENP

SEQ ID NO: 68712 - protein, 586 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 68713 - protein, 595 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 68714 - protein, 555 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVRIWQV

SEQ ID NO: 68715 - protein, 416 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANRSGKSENP

SEQ ID NO: 68716 - protein, 461 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVRIWQV

SEQ ID NO: 68717 - protein, 487 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKHLLSACFRNELVEPRRETPKQSDVFFRHSKPPNRSVYP

SEQ ID NO: 68718 - protein, 393 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKHLLSACFRNELVEPRRETPKQSDVFFRHSKPPNRSVYP

SEQ ID NO: 68719 - protein, 676 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDAFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 68720 - protein, 501 aa, Homo sapiens
MLYLENNAQTQFSEYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 68721 - protein, 582 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDAFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 68722 - protein, 188 aa, Homo sapiens
MIIYRDLISHDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKCVSTRKWVKINNVKKTF

SEQ ID NO: 68723 - protein, 138 aa, Homo sapiens
MVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKC

SEQ ID NO: 68724 - protein, 138 aa, Homo sapiens; identical to SEQ ID NO: 68723

SEQ ID NO: 68725 - protein, 160 aa, Homo sapiens
MFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKC

SEQ ID NO: 68726 - protein, 172 aa, Homo sapiens
MIIYRDLISHDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKC

SEQ ID NO: 68727 - protein, 387 aa, Homo sapiens
MEDDAPVIYGLEFQARALTPQTAETDAIRFLVGTQSLKYDNQIHIIDFDDENNIINKNVLLHQAGEIWHISASPADRGVLTTCYNRTSDSKVLTCAAVWRMPKELESGSHESPDDSSSTAQTLELLCHLDNTAHGNMACVVWEPMGDGKKIISLADNHILLWDLQESSSQAVLASSASLEGKGQLKFTSGRWSPHHNCTQVATANDTTLRGWDTRSMSQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEEKSKEPLQDNVIATYEEHEDSVYAVDWSSADPWLFASLSYDGRLVINRVPRALKYHILL

SEQ ID NO: 68728 - protein, 329 aa, Homo sapiens
MAEAGTGEPSPSVEGEHGTEYDTLPSDTVSLSDSDSDLSLPGGAEVEALSPMGLPGEEDSGPDEPPSPPSGLLPATVQPFHLRGMSSTFSQRSRDIFDCLEGAARRAPSSVAHTSMSDNGGFKRPLAPSGRSPVEGLGRAHRSPASPRVPPVPDYVAHPERWTKYSLEDVTEVSEQSNQATALAFLGSQSLAAPTDCVSSFNQDPSSCGEGRVIFTKPVRGVEARHERKRVLGKVGEPGRGGLGNPATDRGEGPVELAHLAGPGSPEAEEWGSHHGGLQEVEALSGSVHSGSVPGLPPVETVGFHGSRKRSRDHFRNKSSSPEDPGAEV

SEQ ID NO: 68729 - protein, 265 aa, Homo sapiens
MAEAGTGLLPATVQPFHLRGMSSTFSQRSRDIFDCLEGAARRAPSSVAHTSMSDNGGFKRPLAPSGRSPVEGLGRAHRSPASPRVPPVPDYVAHPERWTKYSLEDVTEVSEQSNQATALAFLGSQSLAAPTDCVSSFNQDPSSCGEGRVIFTKPVRGVEARHERKRVLGKVGEPGRGGLGNPATDRGEGPVELAHLAGPGSPEAEEWGSHHGGLQEVEALSGSVHSGSVPGLPPVETVGFHGSRKRSRDHFRNKSSSPEDPGAEV

SEQ ID NO: 68730 - protein, 112 aa, Homo sapiens
MAEAGTGEPSPSVEGEHGTEYDTLPSDTVSLSDSDSDLSLPGGAEVEALSPMGLPGEEDSGPDEPPSPPSGLLPATVQPFHLRGMSSTFSQRSRDIFDCLEGAARRAPSSVA

SEQ ID NO: 68731 - protein, 203 aa, Homo sapiens
MAEAGTGEPSPSVEGEHGTEYDTLPSDTVSLSDSDSDLSLPGGAEVEALSPMGLPGEEDSGPDEPPSPPSGLLPATVQPFHLRGMSSTFSQRSRDIFDCLEGAARRAPSSVAHTSMSDNGGFKRPLAPSGRSPVEGLGRAHRSPASPRVPPVPDYVAHPERWTKYSLEDVTEVSEQSNQATALAFLGSQSLAAPTDCVSSFNQ

SEQ ID NO: 68732 - protein, 208 aa, Homo sapiens
MAEAGTGLLPATVQPFHLRGMSSTFSQRSRDIFDCLEGAARRAPSSVAHTSMSDNGGFKRPLAPSGRSPVEGLGRAHRSPASPRVPPVPDYVAHPERWTKYSLEDVTEVSEQSNQATALAFLGSQSLAAPTDCVSSFNQDPSSCGEGRVIFTKPVRGVEARHERKRVLGKVGEPGRGGLGNPATDRGEGPVELAHLAGPGSPEAEEWG

SEQ ID NO: 68733 - protein, 329 aa, Homo sapiens; identical to SEQ ID NO: 68728

SEQ ID NO: 68734 - protein, 110 aa, Homo sapiens
MAEAGTGEPSPSVEGEHGTEYDTLPSDTVSLSDSDSDLSLPGGAEVEALSPMGLPGEEDSGPDEPPSPPSGLLPATVQPFHLRGMSSTFSQRSRDIFDCLEGAARRAPSS

SEQ ID NO: 68735 - protein, 191 aa, Homo sapiens
MAEAGTGEPSPSVEGEHGTEYDTLPSDTVSLSDSDSDLSLPGGAEVEALSPMGLPGEEDSGPDEPPSPPSGLLPATVQPFHLRGMSSTFSQRSRDIFDCLEGAARRAPSSVAHTSMSDNGGFKRPLAPSGRSPVEGLGRAHRSPASPRVPPVPDYVAHPERWTKYSLEDVTEVSEQSNQATALAFLGSQSL

SEQ ID NO: 68736 - protein, 212 aa, Homo sapiens
MGPMWRMRGGATRRGSCCGGDGAADGRGPGRSGRARGGGSPSGGGGGVGWRGRADGARQQLEERFADLAASHLEAIRARDEWDRQNARLRQENARLRLENRRLKRENRSLFRQALRLPGEGGNGTPAEARRVPEEASTNRRARDSGREDEPGSPRALRARLEKLEAMYRRALLQLHLEQRGPRPSGDKEEQPLQEPDSGLRSRDSEPSGPWL

SEQ ID NO: 68737 - protein, 348 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSDLDFE

SEQ ID NO: 68738 - protein, 347 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSFLIK

SEQ ID NO: 68739 - protein, 348 aa, Homo sapiens; identical to SEQ ID NO: 68737

SEQ ID NO: 68740 - protein, 348 aa, Homo sapiens; identical to SEQ ID NO: 68737

SEQ ID NO: 68741 - protein, 177 aa, Homo sapiens
MAHPVQSEFPSAQEPGSAAFLDLPEMEILLTKAENKDDKTLNLSKTLSGPLDLEQNSQGLPFKAISEGHLEAPLPRSPSRASSRRASSIATTSYAQDQEAPRDYLILAVVACFCPVWPLNLIPLIISIMSRSSMQQGNVDGARRLGRLARLLSITLIIMGIVIIMVAVTVNFTVQKK

SEQ ID NO: 68742 - protein, 390 aa, Homo sapiens
MAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHPQSDLLGLIQVMIVVFGDEPPVFSRPISASYPPYQATGPPNTSYMPGMPGGISPYPSGYPPNPSGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDTIFYLGEALRRGVIDLDVFLKHVRLLSRKQFQLRALMQKARKTAGLSDLY

SEQ ID NO: 68743 - protein, 285 aa, Homo sapiens
MAVSESQLKKMVSKPQSDLLGLIQVMIVVFGDEPPVFSRPISASYPPYQATGPPNTSYMPGMPGGISPYPSGYPPNPSGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDTIFYLGEALRRGVIDLDVFLKHVRLLSRKQFQLRALMQKARKTAGLSDLY

SEQ ID NO: 68744 - protein, 323 aa, Homo sapiens
MARGPGLAPPPLRLPLLLLVLAAVTGHTAAQDNCTCPTNKMTVCSPDGPGGRCQCRALGSGMAVDCSTLTSKCLLLKARMSAPKNARTLVRPSEHALVDNDGLYDPDCDPEGRFKARQCNQTSVCWCVNSVGVRRTDKGDLSLRCDELVRTHHILIDLRHRPTAGAFNHSDLDAELRRLFRERYRLHPKFVAAVHYEQPTIQIELRQNTSQKAAGDVDIGDAAYYFERDIKGESLFQGRGGLDLRVRGEPLQVERTLIYYLDEIPPKFSMKRLTAGLIAVIVVVVVALVAGMAVLVITNRRKSGKYKKVEIKELGELRKEPSL

SEQ ID NO: 68745 - protein, 450 aa, Homo sapiens
MGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPSDDYDDTDDDDPFNPQESKRFVQWQSSI

SEQ ID NO: 68746 - protein, 460 aa, Homo sapiens
MGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPRNPSALCSGSRLSEPLLPAGLEPGSPLRSFPGCRRRPH

SEQ ID NO: 68747 - protein, 453 aa, Homo sapiens
MGAPPGYRPSAWVHLLHQLPRADFQLRPVPSVFAPQEQEYQQDQSSLAVTQRPPPTTPLHRLRPRPRLTPALARRPPEAARGDPRPQSPPEALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSEADSVPASSGQHPLPAAGPGARSCASVPFSAEASAVLGGDSECDRRKFPPVGGTATLPQPAQGLWCSPAGPVRRRPGRPALPATLLPAVCRSAGHCPLQPAPSLGPLPTQ

SEQ ID NO: 68748 - protein, 451 aa, Homo sapiens
MGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPSDDYDDTDDDDPFNPQQESKRFVQWQSSI

SEQ ID NO: 68749 - protein, 384 aa, Homo sapiens
MTRRGRRRSSHFLGPPAGAAGCTQRRSRELAAAAMSHQTGIQASEDVKEIFARARNGKYRLLKISIENEQLVIGSYSQPSDSWDKDYDSFVLPLLEDKQPCYILFRLDSQNAQGYEWIFIAWSPDHSHVRQKMLYAATRATLKKEFGGGHIKDEVFGTVKEDVSLHGYKKYLLSQSSPAPLTAAEEELRQIKINEVQTDVGVDTKHQTLQGVAFPISREAFQALEKLNNRQLNYVQLEIDIKNEIIILANTTNTELKDLPKRIPKDSARYHFFLYKHSHEGDYLESIVFIYSMPGYTCSIRERMLYSSCKSRLLEIVERQLQMDVIRKIEIDNGDELTADFLYEEVHPKQHAHKQSFAKPKGPAGKRGIRRLIRGPAETEATTD

SEQ ID NO: 68750 - protein, 350 aa, Homo sapiens
MSHQTGIQASEDVKEIFARARNGKYRLLKISIENEQLVIGSYSQPSDSWDKDYDSFVLPLLEDKQPCYILFRLDSQNAQGYEWIFIAWSPDHSHVRQKMLYAATRATLKKEFGGGHIKDEVFGTVKEDVSLHGYKKYLLSQSSPAPLTAAEEELRQIKINEVQTDVGVDTKHQTLQGVAFPISREAFQALEKLNNRQLNYVQLEIDIKNEIIILANTTNTELKDLPKRIPKDSARYHFFLYKHSHEGDYLESIVFIYSMPGYTCSIRERMLYSSCKSRLLEIVERQLQMDVIRKIEIDNGDELTADFLYEEVHPKQHAHKQSFAKPKGPAGKRGIRRLIRGPAETEATTD

SEQ ID NO: 68751 - protein, 357 aa, Homo sapiens
MSHQTGIQASEDVKEIFARARNGKYRLLKISIENEQLVIGSYSQPSDSWDKDYDSFVLPLLEDKQPCYILFRLDSQNAQGYEWIFIAWSPDHSHVRQKMLYAATRATLKKEFGGGHIKDEVFGTVKEDVSLHGYKKYLLSQSSPAPLTAAEEELRQIKINESPEDHIGVQTDVGVDTKHQTLQGVAFPISREAFQALEKLNNRQLNYVQLEIDIKNEIIILANTTNTELKDLPKRIPKDSARYHFFLYKHSHEGDYLESIVFIYSMPGYTCSIRERMLYSSCKSRLLEIVERQLQMDVIRKIEIDNGDELTADFLYEEVHPKQHAHKQSFAKPKGPAGKRGIRRLIRGPAETEATTD

SEQ ID NO: 68752 - protein, 349 aa, Homo sapiens
MAHQTGIHATEELKEFFAKARAGSVRLIKVVIEDEQLVLGASQEPVGRWDQDYDRAVLPLLDAQQPCYLLYRLDSQNAQGFEWLFLAWSPDNSPVRLKMLYAATRATVKKEFGGGHIKDELFGTVKDDLSFAGYQKHLSSCAAPAPLTSAERELQQIRINEVKTEISVESKHQTLQGLAFPLQPEAQRALQQLKQKMVNYIQMKLDLERETIELVHTEPTDVAQLPSRVPRDAARYHFFLYKHTHEGDPLESVVFIYSMPGYKCSIKERMLYSSCKSRLLDSVEQDFHLEIAKKIEIGDGAELTAEFLYDEVHPKQHAFKQAFAKPKGPGGKRGHKRLIRGPGENGDDS

SEQ ID NO: 68753 - protein, 160 aa, Homo sapiens
MEEGSSSPVSPVDSLGTSEEELERQPKRFGRKRRYSKKSSEDGSPTPGKRGKKGSPSAQSFEELQSQRILANVRERQRTQSLNEAFAALRKIIPTLPSDKLSKIQTLKLAARYIDFLYQVLQSDEMDNKMTSCSYVAHERLSYAFSVWRMEGAWSMSASH

SEQ ID NO: 68754 - protein, 338 aa, Homo sapiens
MAAGCSEAPRPAAASDGSLVGQAGVLPCLELPTYAAACALVNSRYSCLVAGPHQRHIALSPRYLNRKRTGIREQLDAELLRYSESLLGVPIAYDNIKVVGELGDIYDDQGHIHLNIEADFVIFCPEPGQKLMGIVNKVSSSHIGCLVHGCFNASIPKPEQLSAEQWQTMEINMGDELEFEVFRLDSDAAGVFCIRGKLNITSLQFKRSEVSEEVTENGTEEAAKKPKKKKKKKDPETYEVDSGTTKLADDADDTPMEESALQNTNNANGIWEEEPKKKKKKKKHQEVQDQDPVFQGSDSSGYQSDHKKKKKKRKHSEEAEFTPPLKCSPKRKGKSNFL

SEQ ID NO: 68755 - protein, 223 aa, Homo sapiens
MKLHYVAVLTLAILMFLTWLPESLSCNKALCASDVSKCLIQELCQCRPGEGNCSCCKECMLCLGALWDECCDCVGMCNPRNYSDTPPTSKSTVEELHEPIPSLFRALTEGDTQLNWNIVSFPVAEELSHHENLVSFLETVNQPHHQNVSVPSNNVHAPYSSDKEHMCTVVYFDDCMSIHQCKISCESMGASKYRWFHNACCECIGPECIDYGSKTVKCMNCMF

SEQ ID NO: 68756 - protein, 816 aa, Homo sapiens
MAVSLDDDVPLILTLDEGGSAPLAPSNGLGQEELPSKNGGSYAIHDSQAPSLSSGGESSPSSPAHNWEMNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQEWYEEHAREQEQQRQLSSSAAPAAQQPPGSRQRSQTVT

SEQ ID NO: 68757 - protein, 748 aa, Homo sapiens
MNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQEWYEEHAREQEQQRQLSSSAAPAAQQPPGSRQRSQTVT

SEQ ID NO: 68758 - protein, 888 aa, Homo sapiens
MESCYIAQAGLELLGSSSSPTLTSQSAEITEDASNGGVSEQHPWPSGFERELKPETISSPGYHILRATGEENMAVSLDDDVPLILTLDEGGSAPLAPSNGLGQEELPSKNGGSYAIHDSQAPSLSSGGESSPSSPAHNWEMNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQEWYEEHAREQEQQRQLSSSAAPAAQQPPGSRQRSQTVT

SEQ ID NO: 68759 - protein, 888 aa, Homo sapiens; identical to SEQ ID NO: 68758

SEQ ID NO: 68760 - protein, 85 aa, Homo sapiens
MAVSLDDDVPLILTLDEGGSAPLAPSNGLGQEELPSKNGGSYAIHDSQAPSLSSGGESSPSSPAHNWEMNYQEAAIYLQEGENND

SEQ ID NO: 68761 - protein, 100 aa, Homo sapiens [sequence omitted]

SEQ ID NO: 68762 - protein, 752 aa, Homo sapiens
MAEPQAESEPLLGGARGGGGDWPAGLTTYRSIQVGPGAAARWDLCIDQAVVFIEDAIQYRSINHRVDASSMWLYRRYYSNVCQRTLSFTIFLILFLAFIETPSSLTSTADVRYRAAPWEPPCGLTESVEVLCLLVFAADLSVKGYLFGWAHFQKNLWLLGYLVVLVVSLVDWTVSLSLVCHEPLRIRRLLRPFFLLQNSSMMKKTLKCIRWSLPEMASVGLLLAIHLCLFTMFGMLLFAGGKQDDGQDRERLTYFQNLPESLTSLLVLLTTANNPDVMIPAYSKNRAYAIFFIVFTVIGSLFLMNLLTAIIYSQFRGYLMKSLQTSLFRRRLGTRAAFEVLSSMVGEGGAFPQAVGVKPQNLLQVLQKVQLDSSHKQAMMEKVRSYGSVLLSAEEFQKLFNELDRSVVKEHPPRPEYQSPFLQSAQFLFGHYYFDYLGNLIALANLVSICVFLVLDADVLPAERDDFILGILNCVFIVYYLLEMLLKVFALGLRGYLSYPSNVFDGLLTVVLLVLEISTLAVYRLPHPGWRPEMVGLLSLWDMTRMLNMLIVFRFLRIIPSMKLMAVVASTVLGLVQNMRAFGGILVVVYYVFAIIGINLFRGVIVALPGNSSLAPANGSAPCGSFEQLEYWANNFDDFAAALVTLWNLMVVNNWQVFLDAYRRYSGPWSKIYFVLWWLVSSVIWVNLFLALILENFLHKWDPRSHLQPLAGTPEATYQMTVELLFRDILEEPGEDELTERLSQHPHLWLCR

SEQ ID NO: 68763 - protein, 468 aa, Homo sapiens
MWLYRRYYSNVCQRTLSFTIFLILFLAFIETPSSLTSTADVRYRAAPWEPPCGLTESVEVLCLLVFAADLSVKGYLFGWAHFQKNLWLLGYLVVLVVSLVDWTVSLSLVCHEPLRIRRLLRPFFLLQNSSMMKKTLKCIRWSLPEMASVGLLLAIHLCLFTMFGMLLFAGGKQDDGQDRERLTYFQNLPESLTSLLVLLTTANNPDVMIPAYSKNRAYAIFFIVFTVIGSLFLMNLLTAIIYSQFRGYLMKSLQTSLFRRRLGTRAAFEVLSSMVGEGGAFPQATRRGPSTSLRFCRAPSSSSATTTLTTWGTSSPWQTWCPFACSWCWMQMCCLLSVMTSSWGFSTASSLCTTCWRCCSRSLPWACEGTCPTPATCLTGSSPLSCWRPEMVGLLSLWDMTRMLNMLIVFRFLRIIPSMKLMAVVASTVLGLVQNMRAFGGILVPGPCQWLGALWELRAAGVLGQQLR

SEQ ID NO: 68764 - protein, 527 aa, Homo sapiens
MILSSYNTIQSVFCCCCCCSVQKRQMRTQISLSTDEELPEKYTQRRRPWLSQLSNKKQSNTGRVQPSKRKPLPPLPPSEVAEEKIQVKALYDFLPREPCNLALRRAEEYLILEKYNPHWWKARDRLGNEGLIPSNYVTENKITNLEIYEWYHRNITRNQAEHLLRQESKEGAFIVRDSRHLGSYTISVFMGARRSTEAAIKHYQIKKNDSGQWYVAERHAFQSIPELIWYHQHNAAGLMTRLRYPVGLMGSCLPATAGFSYEKWEIDPSELAFIKEIGSGQFGVVHLGEWRSHIQVAIKAINEGSMSEEDFIEEAKVMMKLSHSKLVQLYGVCIQRKPLYIVTEFMENGCLLNYLRENKGKLRKEMLLSVCQDICEGMEYLERNGYIHRDLAARNCLVSSTCIVKISDFGMTRYVLDDEYVSSFGAKFPIKWSPPEVFLFNKYSSKSDVWSFGVLMWEVFTEGKMPFENKSNLQVVEAISEGFRLYRPHLAPMSIYEVMYSCWHEKPEGRPTFAELLRAVTEIAETW

SEQ ID NO: 68765 - protein, 113 aa, Homo sapiens
MGGLEPCSRLLLLPLLLAVSGLRPVQAQAQSDCSCSTVSPGVLAGIVMGDLVLTVLIALAVYFLGRLVPRGRGAAEAATRKQRITETESPYQELQGQRSDVYSDLNTQRPYYK

SEQ ID NO: 68766 - protein, 112 aa, Homo sapiens
MGGLEPCSRLLLLPLLLAVSGLRPVQAQAQSDCSCSTVSPGVLAGIVMGDLVLTVLIALAVYFLGRLVPRGRGAAEATRKQRITETESPYQELQGQRSDVYSDLNTQRPYYK

SEQ ID NO: 68767 - protein, 102 aa, Homo sapiens
MGGLEPCSRLLLLPLLLAVSDCSCSTVSPGVLAGIVMGDLVLTVLIALAVYFLGRLVPRGRGAAEAATRKQRITETESPYQELQGQRSDVYSDLNTQRPYYK

SEQ ID NO: 68768 - protein, 112 aa, Homo sapiens; identical to SEQ ID NO: 68766

SEQ ID NO: 68769 - protein, 890 aa, Homo sapiens
MALRRSMGRPGLPPLPLPPPPRLGLLLAALASLLLPESAAAGLKLMGAPVKLTVSQGQPVKLNCSVEGMEEPDIQWVKDGAVVQNLDQLYIPVSEQHWIGFLSLKSVERSDAGRYWCQVEDGGETEISQPVWLTVEGVPFFTVEPKDLAVPPNAPFQLSCEAVGPPEPVTIVWWRGTTKIGGPAPSPSVLNVTGVTQSTMFSCEAHNLKGLASSRTATVHLQALPAAPFNITVTKLSSSNASVAWMPGADGRALLQSCTVQVTQAPGGWEVLAVVVPVPPFTCLLRDLVPATNYSLRVRCANALGPSPYADWVPFQTKGLAPASAPQNLHAIRTDSGLILEWEEVIPEAPLEGPLGPYKLSWVQDNGTQDELTVEGTRANLTGWDPQKDLIVRVCVSNAVGCGPWSQPLVVSSHDRAGQQGPPHSRTSWVPVVLGVLTALVTAAALALILLRKRRKETRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQTPYAGIENAEIYNYLIGGNRLKQPPECMEDVYDLMYQCWSADPKQRPSFTCLRMELENILGQLSVLSASQDPLYINIERAEEPTAGGSLELPGRDQPYSGAGDGSGMGAVGGTPSDCRYILTPGGLAEQPGQAEHQPESPLNETQRLLLLQQGLLPHSSC

SEQ ID NO: 68770 - protein, 842 aa, Homo sapiens
MEEPDIQWVKDGAVVQNLDQLYIPVSEQHWIGFLSLKSVERSDAGRYWCQVEDGGETEISQPVWLTVEGVPFFTVEPKDLAVPPNAPFQLSCEAVGPPEPVTIVWWRGTTKIGGPAPSPSVLNVTGVTQSTMFSCEAHNLKGLASSRTATVHLQALPAAPFNITVTKLSSSNASVAWMPGADGRALLQSCTVQVTQAPGGWEVLAVVVPVPPFTCLLRDLVPATNYSLRVRCANALGPSPYADWVPFQTKGLAPASAPQNLHAIRTDSGLILEWEEVIPEAPLEGPLGPYKLSWVQDNGTQDELTVEGTRANLTGWDPQKDLIVRVCVSNAVGCGPWSQPLVVSSHDRAGQQGPPHSRTSWVPVVLGVLTALVTAAALALILLRKRRKETRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQTPYAGIENAEIYNYLIGGNRLKQPPECMEDVYDLMYQCWSADPKQRPSFTCLRMELENILGQLSVLSASQDPLYINIERAEEPTAGGSLELPGRDQPYSGAGDGSGMGAVGGTPSDCRYILTPGGLAEQPGQAEHQPESPLNETQRLLLLQQGLHTVAVSPQAEGIGAIWPALVATELAD

SEQ ID NO: 68771 - protein, 246 aa, Homo sapiens
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLIPNATQPESKVFYLKMKGDYFRYLSEVASGDNKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 68772 - protein, 246 aa, Homo sapiens; identical to SEQ ID NO: 68771

SEQ ID NO: 68773 - protein, 100 aa, Homo sapiens
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVL

SEQ ID NO: 68774 - protein, 74 aa, Homo sapiens
MTMDKSELVQKAKLAEQAERYDDMAAAMKAVTEQGHELSNEERNLLSVAYKNVVGARRSSWRVISSIEQKTERN

SEQ ID NO: 68775 - protein, 255 aa, Homo sapiens
MDDREDLVYQAKLAEQAERYDEMVESMKKVAGMDVELTVEERNLLSVAYKNVIGARRASWRIISSIEQKEENKGGEDKLKMIREYRQMVETELKLICCDILDVLDKHLIPAANTGESKVFYYKMKGDYHRYLAEFATGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDGEEQNKEALQDVEDENQ

SEQ ID NO: 68776 - protein, 233 aa, Homo sapiens
MVESMKKVAGMDVELTVEERNLLSVAYKNVIGARRASWRIISSIEQKEENKGGEDKLKMIREYRQMVETELKLICCDILDVLDKHLIPAANTGESKVFYYKMKGDYHRYLAEFATGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDGEEQNKEALQDVEDENQ

SEQ ID NO: 68777 - protein, 247 aa, Homo sapiens
MVDREQLVQKARLAEQAERYDDMAAAMKNVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 68778 - protein, 207 aa, Homo sapiens
MVDREQLVQKARLAEQAERYDDMAAAMKNVTELNEPLSNEERNLLSVAYKNVVGARRSSWRVISSIEQKTSADGNEKKIEMVRAYREKIEKELEAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 68779 - protein, 225 aa, Homo sapiens
MAAAMKNVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 68780 - protein, 245 aa, Homo sapiens
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQAESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 68781 - protein, 168 aa, Homo sapiens
MAREYREKIETELRDICNDVLSLLEKFLIPNASQAESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 68782 - protein, 245 aa, Homo sapiens; identical to SEQ ID NO: 68780

SEQ ID NO: 68783 - protein, 245 aa, Homo sapiens; identical to SEQ ID NO: 68780

SEQ ID NO: 68784 - protein, 245 aa, Homo sapiens; identical to SEQ ID NO: 68780

SEQ ID NO: 68785 - protein, 245 aa, Homo sapiens; identical to SEQ ID NO: 68780

SEQ ID NO: 68786 - protein, 245 aa, Homo sapiens; identical to SEQ ID NO: 68780

SEQ ID NO: 68787 - protein, 98 aa, Homo sapiens
MDKNELVQKAKLAEQAERYDDMAACMKSVTEQGAELSNEERNLLSVAYKNVVGARRSSWRVVSSIEQKTEGAEKKQQMAREYREKIETELRDICNDVL

SEQ ID NO: 68788 - protein, 245 aa, Homo sapiens; identical to SEQ ID NO: 68780

SEQ ID NO: 68789 - protein, 92 aa, Homo sapiens
MDKNELVQKAKLAEQAERYDDMAACMKSVTEQGAELSNEERNLLSVAYKNVVGARRSSWRVVSSIEQKTEGAEKKQQMAREYREKIETELRD

SEQ ID NO: 68790 - protein, 245 aa, Homo sapiens; identical to SEQ ID NO: 68780

SEQ ID NO: 68791 - protein, 168 aa, Homo sapiens; identical to SEQ ID NO: 68781

SEQ ID NO: 68792 - protein, 125 aa, Homo sapiens
MKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 68793 - protein, 137 aa, Homo sapiens
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQAESKVFYLKMKGDYYRYLAEVAAGDD

SEQ ID NO: 68794 - protein, 246 aa, Homo sapiens
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQAESKVFYLKMKGDYYRYLAEVAAGDDKKVRFGVSYPGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAE

SEQ ID NO: 68795 - protein, 170 aa, Homo sapiens
MSQPCRKLWRHNYETSSCIEFLKSLLEKFLIPNASQAESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 68796 - protein, 125 aa, Homo sapiens; identical to SEQ ID NO: 68792

SEQ ID NO: 68797 - protein, 75 aa, Homo sapiens
MDKNELVQKAKLAEQAERYDDMAACMKSVTEQGAELSNEERNLLSVAYKNVVGARRSSWRVVSSIEQKTEGAEKK

SEQ ID NO: 68798 - protein, 130 aa, Homo sapiens
VFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 68799 - protein, 52 aa, Homo sapiens
MDKNELVQKAKLAEQAERYDDMAACMKSVTEQGAELSNEERNLLSVAYKNVV

SEQ ID NO: 68800 - protein, 407 aa, Homo sapiens
MPTPDATTPQAKGFRRAVSELDAKQAEAIMVRGQSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 68801 - protein, 497 aa, Homo sapiens
MPTPDATTPQAKGFRRAVSELDAKQAEAIMSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 68802 - protein, 524 aa, Homo sapiens
MPTPDATTPQAKGFRRAVSELDAKQAEAIMGAPGPSLTGSPWPGTAAPAASYTPTPRSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 68803 - protein, 528 aa, Homo sapiens
MPTPDATTPQAKGFRRAVSELDAKQAEAIMVRGQGAPGPSLTGSPWPGTAAPAASYTPTPRSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 68804 - protein, 1187 aa, Homo sapiens
MPLRHWGMARGSKPVGDGAQPMAAMGGLKVLLHWAGPGGGEPWVTFSESSLTAEEVCIHIAHKVGITPPCFNLFALFDAQAQVWLPPNHILEIPRDASLMLYFRIRFYFRNWHGMNPREPAVYRCGPPGTEASSDQTAQGMQLLDPASFEYLFEQGKHEFVNDVASLWELSTEEEIHHFKNESLGMAFLHLCHLALRHGIPLEEVAKKTSFKDCIPRSFRRHIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHRVDQKEITQLSHLGQGTRTNVYEGRLRVEGSGDPEEGKMDDEDPLVPGRDRGQELRVVLKVLDPSHHDIALAFYETASLMSQVSHTHLAFVHGVCVRGPENIMVTEYVEHGPLDVWLRRERGHVPMAWKMVVAQQLASALSYLENKNLVHGNVCGRNILLARLGLAEGTSPFIKLSDPGVGLGALSREERVERIPWLAPECLPGGANSLSTAMDKWGFGATLLEICFDGEAPLQSRSPSEKEHFYQRQHRLPEPSCPQLATLTSQCLTYEPTQRPSFRTILRDLTRLQPHNLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGEKSLQLVMEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPTKFLELIGIAQGQMTVLRLTELLERGERLPRPDKCPCEVYHLMKNCWETEASFRPTFENLIPILKTVHEKYQGQAPSVFSVC

SEQ ID NO: 68805 - protein, 1187 aa, Homo sapiens; identical to SEQ ID NO: 68804

SEQ ID NO: 68806 - protein, 118 aa, Homo sapiens
MPLRHWGMARGSKPVGDGAQPMAAMGGLKVLLHWAGPGGGEPWVTFSESSLTAEEVCIHIAHKVGITPPCFNLFALFDAQAQVWLPPNHILEIPRDASLMLYFRIRFYFRNWHGMNPR

SEQ ID NO: 68807 - protein, 934 aa, Homo sapiens
MVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHRVDQKEITQLSHLGQGTRTNVYEGRLRVEGSGDPEEGKMDDEDPLVPGRDRGQELRVVLKVLDPSHHDIALAFYETASLMSQVSHTHLAFVHGVCVRGPENIMVTEYVEHGPLDVWLRRERGHVPMAWKMVVAQQLASALSYLENKNLVHGNVCGRNILLARLGLAEGTSPFIKLSDPGVGLGALSREERVERIPWLAPECLPGGANSLSTAMDKWGFGATLLEICFDGEAPLQSRSPSEKEHFYQRQHRLPEPSCPQLATLTSQCLTYEPTQRPSFRTILRDLTRLQPHNLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGEKSLQLVMEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPTKFLELIGIAQGQMTVLRLTELLERGERLPRPDKCPCEVYHLMKNCWETEASFRPTFENLIPILKTVHEKYQGQAPSVFSVC

SEQ ID NO: 68808 - protein, 661 aa, Homo sapiens
MLPEAGSLWLLKLLRDIQLAQFYWPILEELNVTRPEHFDFVKPEDLDGIGMGRPAQRRLSEALKRLRSGPKSKNWVYKILGGFAPEHKEPTLPSDSPRHLPEPEGGLKCLIPEGAVCRGELLGSGCFGVVHRGLWTLPSGKSVPVAVKSLRVGPEGPMGTELGDFLREVSVMMNLEHPHVLRLHGLVLGQPLQMVMELAPLGSLHARLTAPAPTPPLLVALLCLFLRQLAGAMAYLGARGLVHRDLATRNLLLASPRTIKVADFGLVRPLGGARGRYVMGGPRPIPYAWCAPESLRHGAFSSASDVWMFGVTLWEMFSGGEEPWAGVPPYLILQRLEDRARLPRPPLCSRALYSLALRCWAPHPADRPSFSHLEGLLQEAGPSEACCVRDVTEPGALRMETGDPITVIEGSPDSTIWKGQNGRTFKVGSFPASAVTLADAGGLPATRPVHRGTPARGDQHPGSIDGDRKKANLWDAPPARGQRRNMPLERMKGISRSLESVLSLGPRPTGGGSSPPEIRQARAVPQGPPGLPPRPPLSSSSPQPSQPSRERLPWPKRKPPHNHPMGMPGARKAAALSGGLLSDPELQRKIMEVELSVHGVTHQECQTALGATGGDVVSAIRNLKVDQLFHLSSRSRADCWRILEHYQWDLSAASRYVLARP

SEQ ID NO: 68809 - protein, 661 aa, Homo sapiens; identical to SEQ ID NO: 68808

SEQ ID NO: 68810 - protein, 528 aa, Homo sapiens
MQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDECPFSAFSPGHPPAETCGQVLWTGRREACASDPRLHPVSSRTKGL

SEQ ID NO: 68811 - protein, 1038 aa, Homo sapiens
MQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMAMVHGVTTEECQAALQCHGWSVQRAAQYLKVEQLFGLGLRPRGECHKVLEMFDWNLEQAGCHLLGSWGPAHHKR

SEQ ID NO: 68812 - protein, 1086 aa, Homo sapiens
MLEARPPRTQGSDAAGAAAGRGLRALLLSLTAAAGIWGSMGERSAYQRLAGGEEGPQRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKREPPPRPPQPAFFTQKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMVEQLFGLGLRPRGECHKVLEMFDWNLEQAGCHLLGSWGPAHHKR

SEQ ID NO: 68813 - protein, 1038 aa, Homo sapiens; identical to SEQ ID NO: 68811

SEQ ID NO: 68814 - protein, 97 aa, Homo sapiens
MQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQST

SEQ ID NO: 68815 - protein, 608 aa, Homo sapiens
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGIWLSPLYPRIADGTHKSGESPTHFKADLISYLMAYNAPSLKEWIDVIHKHDLSETNVYLIGSTPGRFQGSQKDNWGHFRLKKLLKDHASSMPNAESWPVVGQFSSVGSLGADESKWLCSEFKESMLTLGKESKTPGKSSVPLYLIYPSVENVRTSLEGYPAGGSLPYSIQTAEKQNWLHSYFHKWSAETSGRSNAMPHIKTYMRPSPDFSKIAWFLVTSANLSKAAWGALEKNGTQLMIRSYELGVLFLPSAFGLDSFKVKQKFFAGSQEPMATFPVPYDLPPELYGSKDRPWIWNIPYVKAPDTHGNMWVPS

SEQ ID NO: 68816 - protein, 369 aa, Homo sapiens
MVISERLRLTSMPRPSLTRTSLSARKMMLLLYEEGLRVVIHTSNLIHADWHQKTQGIWLSPLYPRIADGTHKSGESPTHFKADLISYLMAYNAPSLKEWIDVIHKHDLSETNVYLIGSTPGRFQGSQKDNWGHFRLKKLLKDHASSMPNAESWPVVGQFSSVGSLGADESKWLCSEFKESMLTLGKESKTPGKSSVPLYLIYPSVENVRTSLEGYPAGGSLPYSIQTAEKQNWLHSYFHKWSAETSGRSNAMPHIKTYMRPSPDFSKIAWFLVTSANLSKAAWGALEKNGTQLMIRSYELGVLFLPSAFGLDSFKVKQKFFAGSQEPMATFPVPYDLPPELYGSKDRPWIWNIPYVKAPDTHGNMWVPS

SEQ ID NO: 68817 - protein, 608 aa, Homo sapiens; identical to SEQ ID NO: 68815

SEQ ID NO: 68818 - protein, 298 aa, Homo sapiens
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGTHL

SEQ ID NO: 68819 - protein, 146 aa, Homo sapiens
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYE

SEQ ID NO: 68820 - protein, 148 aa, Homo sapiens
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETS

SEQ ID NO: 68821 - protein, 279 aa, Homo sapiens
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVI

SEQ ID NO: 68822 - protein, 161 aa, Homo sapiens
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKG

SEQ ID NO: 68823 - protein, 151 aa, Homo sapiens
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEG

SEQ ID NO: 68824 - protein, 370 aa, Homo sapiens
MVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQAFLLEIIVKHGEPAPYLCNKDPFALKSLTYLSRLFPNAKFLLMVRDGRASVHSMISRKVTIAGFDLNSYRDCLTKWNRAIETMYNQCMEVGYKKCMLVHYEQLVLHPERWMRTLLKFLQIPWNHSVLHHEEMIGKAGGVSLSKVERSTDQVIKPVNVGALSKWVGKIPPDVLQDMAVIAPMLAKLGYDPYANPPNYGKPDPKIIENTRRVYKGEFQLPDFLKEKPQTEQVE

SEQ ID NO: 68825 - protein, 42 aa, Homo sapiens
MVGKLKQNLLLACLVISSVTVFYLGQHAMECHHRIEERSQPV

SEQ ID NO: 68826 - protein, 140 aa, Homo sapiens
MVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQA

SEQ ID NO: 68827 - protein, 360 aa, Homo sapiens
MVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQAFLLEIIVKHGEPAPYLCNKDPFALKSLTYLSRLFPNAKFLLMVRDGRASVHSMISRKVTIAGFDLNSYRDCLTKWNRAIETMYNQCMEVGYKKCMLVHYEQLVLHPERWMRTLLKFLQIPWNHSVLHHEEMIGKAGGVSLSKVERSTDQVIKPVNVGALSKWVGKIPPDVLQDMAVIAPMLAKLGYDPYANPPNYGKPDPKIIENTRRERLLPFQQKGNS

SEQ ID NO: 68828 - protein, 377 aa, Homo sapiens
MRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREKLRLDEAGVTDEVLDAAMQAFILEVIAKHGEPARVLCNKDPFTLKSSVYLSRLFPNSKFLLMVRDGRASVHSMITRKVTIAGFDLSSYRDCLTKWNKAIEVMYAQCMEVGKEKCLPVYYEQLVLHPRRSLKLILDFLGIAWSDAVLHHEDLIGKPGGVSLSKIERSTDQVIKPVNLEALSKWTGHIPGDVVRDMAQIAPMLAQLGYDPYANPPNYGNPDPFVINNTQRVLKGDYKTPANLKGYFQVNQNSTSSHLGSS

SEQ ID NO: 68829 - protein, 377 aa, Homo sapiens; identical to SEQ ID NO: 68828

SEQ ID NO: 68830 - protein, 377 aa, Homo sapiens; identical to SEQ ID NO: 68828

SEQ ID NO: 68831 - protein, 64 aa, Homo sapiens
MRLSVRRVLLAAGCALVLVLAVQLGQQVLECRAVLAGLRSPRGAMRPEQEELVMVGTNHVEYRY

SEQ ID NO: 68832 - protein, 142 aa, Homo sapiens
MRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREKLRLDEAGVTDEVLDAAMQAFIL

SEQ ID NO: 68833 - protein, 47 aa, Homo sapiens
MRLSVRRVLLAAGCALVLVLAVQLGQQVLECRAVLAGLRSPRGAMRP

SEQ ID NO: 68834 - protein, 48 aa, Homo sapiens
MRLSVRRVLLAAGCALVLVLAVQLGQQVLECRAVLAGLRSPRGAMRPE

SEQ ID NO: 68835 - protein, 120 aa, Homo sapiens
MRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREK

SEQ ID NO: 68836 - protein, 310 aa, Homo sapiens
MPLIFVGGVPRSGTTLMRAMLDAHPEVRCGEETRIIPRVLAMRQAWSKSGREKLRLDEAGVTDEVLDAAMQAFILEVIAKHGEPARVLCNKDPFTLKSSVYLSRLFPNSKFLLMVRDGRASVHSMITRKVTIAGFDLSSYRDCLTKWNKAIEVMYAQCMEVGKEKCLPVYYEQLVLHPRRSLKLILDFLGIAWSDAVLHHEDLIGKPGGVSLSKIERSTDQVIKPVNLEALSKWTGHIPGDVVRDMAQIAPMLAQLGYDPYANPPNYGNPDPFVINNTQRVLKGDYKTPANLKGYFQVNQNSTSSHLGSS

SEQ ID NO: 68837 - protein, 528 aa, Homo sapiens
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQADFKISEECIAQWKQTNFMTKLGSISCKSLKGGNIS

SEQ ID NO: 68838 - protein, 477 aa, Homo sapiens
MAAPILRSFSWGRWSGTLNLSVLLPLGLRKAHSGAQGLLAAQKARGLFKDFFPETGTKIELPELFDRGTASFPQTIYCGFDPTADSLHVGHLLALLGLFHLQRAGHNVIALVGGATARLGDPSGRTKEREALETERVRANARALRLGLEALAANHQQLFTDGRSWGSFTVLDNSAWYQKQHLVDFLAAVGGHFRMGTLLSRQSVQLRLKSPEGMSLAEFFYQVLQAYDFYYLFQRYGCRVQLGGSDQLGNIMSGYEFINKLTGEDVFGITVPLITSTTGAKLGKSAGNAVWLNRDKTSPFELYQFFVRQPDDSVERYLKLFTFLPLPEIDHIMQLHVKEPERRGPQKRLAAEVTKLVHGREGLDSAKRCTQALYHSSIDALEVMSDQELKELFKEAPFSEFFLDPGTSVLDTCRKANAIPDGPRGYRMITEGGVSINHQQVTNPESVLIVGQHILKNGLSLLKIGKRNFYIIKWLQL

SEQ ID NO: 68839 - protein, 240 aa, Homo sapiens
MAEYLASIFGTEKDKVNCSFYFKIGACRHGDRCSRLHNKPTFSQTIALLNIYRNPQNSSQSADGLRCAVSDVEMQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 68840 - protein, 240 aa, Homo sapiens
MAEYLASIFGTEKDKVNCSFYFKIGACRHGDRCSRLHNKPTFSQTILIQNIYRNPQNSAQTADGSHCAVSDVEMQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 68841 - protein, 167 aa, Homo sapiens
MQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 68842 - protein, 167 aa, Homo sapiens; identical to SEQ ID NO: 68841

SEQ ID NO: 68843 - protein, 405 aa, Homo sapiens
MFVQEEKIFAGKVLRLHICASDGAEWLEEATEDTSVEKLKERCLKHCAHGSLEDPKSITHHKLIHAASERVLSDARTILEENIQDQDVLLLIKKRAPSPLPKMADVSAEEKKKQDQKAPDKEAILRATANLPSYNMDRAAVQTNMRDFQTELRKILVSLIEVAQKLLALNPDAVELFKKANAMLDEDEDERVDEAALRQLTEMGFPENRATKALQLNHMSVPQAMEWLIEHAEDPTIDTPLPGQAPPEAEGATAAASEAAAGASATDEEARDELTEIFKKIRRKREFRADARAVISLMEMGFDEKEVIDALRVNNNQQNAACEWLLGDRKPSPEELDKGIDPDSPLFQAILDNPVVQLGLTNPKTLLAFEDMLENPLNSTQWMNDPETGPVMLQISRIFQTLNRT

SEQ ID NO: 68844 - protein, 179 aa, Homo sapiens
MAASQVLGEKINILSGETVKAGDRDPLGNDCPEQDRLPQRSWRQKCASYVLALRPWSFSASLTPVALGSALAYRSHGVLDPRLLVGCAVAVLAVHGAGNLVNTYYDFSKGIDHKKSDDRTLVDRILEPQDVVRFGVFLYTLGCVCAACLYYLSPLKLEHLALIYFGGLSGSFLYTGVLI

SEQ ID NO: 68845 - protein, 338 aa, Homo sapiens
MAASQVLGEKINILSGETVKAGDRDPLGNDCPEQDRLPQRSWRQKCASYVLALRPWSFSASLTPVALGSALAYRSHGVLDPRLLVGCAVAVLAVHGAGNLVNTYYDFSKGIDHKKSDDRTLVDRILEPQDVVRFGVFLYTLGCVCAACLYYLSPLKLEHLALIYFGGLSGSFLYTGGIGFKYVALGDLIILITFGPLAVMFAYAIQVGSLAIFPLVYAIPLALSTEAILHSNNTRDMESDREAGIVTLAILIGPTFSYILYNTLLFLPYLVFSILATHCTISLALPLLTIPMAFSLERQFRSQAFNKLPQRTAKLNLLLGLFYVFGIILAPAGSLPKI

SEQ ID NO: 68846 - protein, 1134 aa, Homo sapiens
MSEPHRVQFTSLPGSLNPAFLKKSRKEEAGAGEQHQDCEPAAAAVRITLTLFEPDHKRCPEFFYPELVKNIRGKVKGLQPGDKKKDLSDPFNDEEKERHKVEALARKFEEKYGGKKRRKDRIQDLIDMGYGYDESDSFIDNSEAYDELVPASLTTKYGGFYINSGTLQFRQASESEDDFIKEKKKKSPKKRKLKEGGEKIKKKKKDDTYDKEKKSKKSKFSKAGFTALNASKEKKKKKYSGALSVKEMLKKFQKEKEAQKKREEEHKPVAVPSAEAQGLRELEGASDPLLSLFGSTSDNDLLQAATAMDSLTDLDLEHLLSESPEGSPFRDMDDGSDSLGVGLDQEFRQPSSLPEGLPAPLEKRVKELAQAARAAEGESRQKFFTQDINGILLDIEAQTRELSSQVRSGVYAYLASFLPCSKDALLKRARKLHLYEQGGRLKEPLQKLKEAIGRAMPEQMAKYQDECQAHTQAKVAKMLEEEKDKEQRDRICSDEEEDEEKGGRRIMGPRKKFQWNDEIRELLCQVVKIKLESQDLERNNKAQAWEDCVKGFLDAEVKPLWPKGWMQARTLFKESRRGHGHLTSILAKKKVMAPSKIKVKESSTKPDKKVSVPSGQIGGPIALPSDHQTGGLSIGASSRELPSQASGGLANPPPVNLEDSLDEDLIRNPASSVEAVSKELAALNSRAAGNSEFTLPAPSKAPAEKVGGVLCTEEKRNFAKPSPSAPPPASSLQSPLNFLAEQALALGQSSQEKKPESSGYKELSCQAPLNKGLPEVHQSKAKHHSLPRTSHGPQVAVPVPGPQVKVFHAGTQQQKNFTPPSPFANKLQGPKASPTQCHRSLLQLVKTAAKGQGFHPSAPATSGGLSASSSSSHKTPASSSSALSHPAKPHSVSSAGSSYKNNPFASSISKHGVSSGSSSSGGTPVQSSVSGSLVPGIQPPSVGQATSRPVPSSAGKKMPVSQKLTLVAPPGGPNGDSSGGTQGVAKLLTSPSLKPSAVSSVTSSTSLSKGASGTVLLAGSSLMASPYKSSSPKLSGAMSSNSLGIITPVPIPVHVLSFSADSSAKAGVSKDAIVTGPAPGSFHHGLGHSLLAGLHSSPPHAAPLPHAAVPTHIPQSLPGASQLHGKGPAVPRKL

SEQ ID NO: 68847 - protein, 1134 aa, Homo sapiens; identical to SEQ ID NO: 68846

SEQ ID NO: 68848 - protein, 1104 aa, Homo sapiens
MSEPHRVQFTSLPGSLNPAFLKKSRKEEAGAGEQHQDCEPAAAAVRITLTLFEPDHKRCPEFFYPELVKNIRGKVKGLQPGDKKKDLSDPFNDEEKERHKVEALARKFEEKYGGKKRRKDRIQDLIDMGYGYDESDSFIDNSEAYDELVPASLTTKYGGFYINSGTLQFRQASESEDDFIKEKKKKSPKKRKLKEGGEKIKKKKKDDTYDKEKKSKKSKFSKAGFTALNASKEKKKKKYSGALSVKEMLKKFQKEKEAQKKREEEHKPVAVPSAEAQGLRELEGASDPLLSLFGSTSDNDLLQAATAMDSLTDLDLEHLLSESPEGSPFRDMDDGSDSLGVGLDQEFRQPSSLPEGLPAPLEKRVKELAQAARAAEGESRQKFFTQDINGILLDIEAQTRELSSQVRSGVYAYLASFLPCSKDALLKRARKLHLYEQGGRLKEPLQKLKEAIGRAMPEQMAKYQDECQAHTQAKVAKMLEEEKDKEQRDRICSDEEEDEEKGGRRIMGPRKKFQWNDEIRELLCQVVKIKLESQDLERNNKAQAWEDCVKGFLDAEVKPLWPKGWMQARTLFKESRRGHGHLTSILAKKKVMAPSKIKVKESSTKPDKKVSVPSGQIGGPIALPSDHQTGGLSIGASSRELPSQASGGLANPPPVNLEDSLDEDLIRNPASSVEAVSKELAALNSRAAGNSEFTLPAPSKAPAEKVGGVLCTEEKRNFAKPSPSAPPPASSLQSPLNFLAEQALALGQSSQEKKPESSGYKELSCQAPLNKGLPEVHQSKAKHHSLPRTSHGPQVAVPVPGPQVKVFHAGTQQQKNFTPPSPFANKLQGPKASPTQCHRSLLQLVKTAAKGQGFHPSAPATSGGLSASSSSSHKTPASSSSALSHPAKPHSVSSAGSSYKNNPFASSISKHGVSSGSSSSGGTPVQSSVSGSLVPGIQPPSVGQATSRPVPSSAGKKMPVSQKLTLVAPPGGPNGDSSGGTQGVAKLLTSPSLKPSAVSSVTSSTSLSKGASGTVLLAGSSLMASPYKSSSPKLSGAMSSNSLGIITPVPIPVHVLSFSADSSAKAGVSKDAIVTGPAPGSFHHGLGHSASQLHGKGPAVPRKL

SEQ ID NO: 68849 - protein, 1264 aa, Homo sapiens
MSLQREPPRPEPPPPFPPLPLQPPPPRESASRAEQPPRPPRETVRLELVLKDPTDESCVEFSYPELLLCGEQRKKLIHTEDPFNDEHQERQEVEMLAKKFEMKYGGKPRKHRKDRLQDLIDIGFGYDETDPFIDNSEAYDELVPASLTTKYGGFYINTGTLQFRQASDTEEDDITDNQKHKPPKVPKIKEDDIEMKKRKRKEEGEKEKKPRKKVPKQLGVVALNSHKSEKKKKRYKDSLSLAAMIRKFQKEKDALKKESNPKVPVTLSTPSLNKPPCAAAALGNDVPDLNLSSGDPDLPIFVSTNEHELFQEAENALEMLDDFDFDRLLDAASDGSPLSESGGENGTTTQPTYTSQVMPKVVPTLPEGLPVLLEKRIEDLRVAAKLFDEEGRKKFFTQDMNNILLDIELQLQELGPVIRSGVYSHLEAFVPCNKETLVKRLKKLHLNVQDDRLREPLQKLKLAVSNVMPEQLFKYQEDCQARSQAKCAKLQTDEEREKNGSEEDDDEKPGKRVIGPRKKFHWDDTIRTLLCNLVEIKLGCYELEPNKSQSAEDYLKSFMETEVKPLWPKGWMQARMLFKESRSVHNHLTSAPAKKKVIPAPKPKVKEVMVKTLPLHSFPTMLKECSPKKDQKTPTSLVASVSGPPTSSSTAAIAAASSSSAPAQETICLDDSLDEDLSFHSPSLDLVSEALAVINNGNKGPPVGSRISMPTTKPRPGLREEKLASIMSKLPLATPKKLDSTQTTHSSSLIAGHTGPVPKKPQDLAHTGISSGLIAGSSIQNPKVSLEPLPARLLQQGLQRSSQIHTSSSSQTHVSSSSQAQIAASSHALGTSEAQDASSLTQVTKVHQHSAVQQNYVSPLQATISKSQTNPVVKLSNNPQLSCSSSLIKTSDKPLMYRLPLSTPSPGNGSQGSHPLVSRTVPSTTTSSNYLAKAMVSQISTQGFKSPFSMAASPKLAASPKPATSPKPLPSPKPSASPKPSLSAKPSVSTKLISKSNPTPKPTVSPSSSSPNALVAQGSHSSTNSPVHKQPSGMNISRQSPTLNLLPSSRTSGLPPTKNLQAPSKLTNSSSTGTVGKNSLSGIAMNVPASRGSNLNSSGANRTSLSGGTGSGTQGATKPLSTPHRPSTASGSSVVTASVQSTAGASLLANASPLTLMTSPLSVTNQNVTPFGMLGGLVPVTMPFQFPLEIFGFGTDTAGVTTTSGSTSAAFHHSLTQNLLKGLQPGGAQHAATLSHSPLPAHLQQAFHDGGQSKGDTKLPRKSQ

SEQ ID NO: 68850 - protein, 1347 aa, Homo sapiens
MAEPRRVAFISLSPVRRREAEYPGPEREPEYPREPPRLEPQPYREPARAEPPAPREPAPRSDAQPPSREKPLPQREVSRAEPPMSLQREPPRPEPPPPFPPLPLQPPPPRESASRAEQPPRPPRETVRLELVLKDPTDESCVEFSYPELLLCGEQRKKLIHTEDPFNDEHQERQEVEMLAKKFEMKYGGKPRKHRKDRLQDLIDIGFGYDETDPFIDNSEAYDELVPASLTTKYGGFYINTGTLQFRQASDTEEDDITDNQKHKPPKVPKIKEDDIEMKKRKRKEEGEKEKKPRKKVPKQLGVVALNSHKSEKKKKRYKDSLSLAAMIRKFQKEKDALKKESNPKVPVTLSTPSLNKPPCAAAALGNDVPDLNLSSGDPDLPIFVSTNEHELFQEAENALEMLDDFDFDRLLDAASDGSPLSESGGENGTTTQPTYTSQVMPKVVPTLPEGLPVLLEKRIEDLRVAAKLFDEEGRKKFFTQDMNNILLDIELQLQELGPVIRSGVYSHLEAFVPCNKETLVKRLKKLHLNVQDDRLREPLQKLKLAVSNVMPEQLFKYQEDCQARSQAKCAKLQTDEEREKNGSEEDDDEKPGKRVIGPRKKFHWDDTIRTLLCNLVEIKLGCYELEPNKSQSAEDYLKSFMETEVKPLWPKGWMQARMLFKESRSVHNHLTSAPAKKKVIPAPKPKVKEVMVKTLPLHSFPTMLKECSPKKDQKTPTSLVASVSGPPTSSSTAAIAAASSSSAPAQETICLDDSLDEDLSFHSPSLDLVSEALAVINNGNKGPPVGSRISMPTTKPRPGLREEKLASIMSKLPLATPKKLDSTQTTHSSSLIAGHTGPVPKKPQDLAHTGISSGLIAGSSIQNPKVSLEPLPARLLQQGLQRSSQIHTSSSSQTHVSSSSQAQIAASSHALGTSEAQDASSLTQVTKVHQHSAVQQNYVSPLQATISKSQTNPVVKLSNNPQLSCSSSLIKTSDKPLMYRLPLSTPSPGNGSQGSHPLVSRTVPSTTTSSNYLAKAMVSQISTQGFKSPFSMAASPKLAASPKPATSPKPLPSPKPSASPKPSLSAKPSVSTKLISKSNPTPKPTVSPSSSSPNALVAQGSHSSTNSPVHKQPSGMNISRQSPTLNLLPSSRTSGLPPTKNLQAPSKLTNSSSTGTVGKNSLSGIAMNVPASRGSNLNSSGANRTSLSGGTGSGTQGATKPLSTPHRPSTASGSSVVTASVQSTAGASLLANASPLTLMTSPLSVTNQNVTPFGMLGGLVPVTMPFQFPLEIFGFGTDTAGVTTTSGSTSAAFHHSLTQNLLKGLQPGGAQHAATLSHSPLPAHLQQAFHDGGQSKGDTKLPRKSQ

SEQ ID NO: 68851 - protein, 561 aa, Homo sapiens
MAESGESGGPPGSQDSAAGAEGAGAPAAAASAEPKIMKVTVKTPKEKEEFAVPENSSVQQFKEEISKRFKSHTDQLVLIFAGKILKDQDTLSQHGIHDGLTVHLVIKTQNRPQDHSAQQTNTAGSNVTTSSTPNSNSTSGSATSNPFGLGGLGGLAGLSSLGLNTTNFSELQSQMQRQLLSNPEMMVQIMENPFVQSMLSNPDLMRQLIMANPQMQQLIQRNPEISHMLNNPDIMRQTLELARNPAMMQEMMRNQDRALSNLESIPGGYNALRRMYTDIQEPMLSAAQEQFGGNPFASLVSNTSSGEGSQPSRTENRDPLPNPWAPQTSQSSSASSGTASTVGGTTGSTASGTSGQSTTAPNLVPGVGASMFNTPGMQSLLQQITENPQLMQNMLSAPYMRSMMQSLSQNPDLAAQMQNPDTLSAMSNPRAMQALLQIQQGLQTLATEAPGLIPGFTPGLGALGSTGGSSGTNGSNATPSENTSPTAGTTEPGHQQFIQQMLQALAGVNPQLQNPEVRFQQQLEQLSAMGFLNREANLQALIATGGDINAAIERLLGSQPS

SEQ ID NO: 68852 - protein, 589 aa, Homo sapiens
MAESGESGGPPGSQDSAAGAEGAGAPAAAASAEPKIMKVTVKTPKEKEEFAVPENSSVQQFKEEISKRFKSHTDQLVLIFAGKILKDQDTLSQHGIHDGLTVHLVIKTQNRPQDHSAQQTNTAGSNVTTSSTPNSNSTSGSATSNPFGLGGLGGLAGLSSLGLNTTNFSELQSQMQRQLLSNPEMMVQIMENPFVQSMLSNPDLMRQLIMANPQMQQLIQRNPEISHMLNNPDIMRQTLELARNPAMMQEMMRNQDRALSNLESIPGGYNALRRMYTDIQEPMLSAAQEQFGGNPFASLVSNTSSGEGSQPSRTENRDPLPNPWAPQTSQSSSASSGTASTVGGTTGSTASGTSGQSTTAPNLVPGVGASMFNTPGMQSLLQQITENPQLMQNMLSAPYMRSMMQSLSQNPDLAAQMMLNNPLFAGNPQLQEQMRQQLPTFLQQMQNPDTLSAMSNPRAMQALLQIQQGLQTLATEAPGLIPGFTPGLGALGSTGGSSGTNGSNATPSENTSPTAGTTEPGHQQFIQQMLQALAGVNPQLQNPEVRFQQQLEQLSAMGFLNREANLQALIATGGDINAAIERLLGSQPS

SEQ ID NO: 68853 - protein, 624 aa, Homo sapiens
MAENGESSGPPRPSRGPAAAQGSAAAPAEPKIIKVTVKTPKEKEEFAVPENSSVQQFKEAISKRFKSQTDQLVLIFAGKILKDQDTLIQHGIHDGLTVHLVIKSQNRPQGQSTQPSNAAGTNTTSASTPRSNSTPISTNSNPFGLGSLGGLAGLSSLGLSSTNFSELQSQMQQQLMASPEMMIQIMENPFVQSMLSNPDLMRQLIMANPQMQQLIQRNPEISHLLNNPDIMRQTLEIARNPAMMQEMMRNQDLALSNLESIPGGYNALRRMYTDIQEPMLNAAQEQFGGNPFASVGSSSSSGEGTQPSRTENRDPLPNPWAPPPATQSSATTSTTTSTGSGSGNSSSNATGNTVAAANYVASIFSTPGMQSLLQQITENPQLIQNMLSAPYMRSMMQSLSQNPDLAAQMMLNSPLFTANPQLQEQMRPQLPAFLQQMQNPDTLSAMSNPRAMQALMQIQQGLQTLATEAPGLIPSFTPGVGVGVLGTAIGPVGPVTPIGPIGPIVPFTPIGPIGPIGPTGPAAPPGSTGSGGPTGPTVSSAAPSETTSPTSESGPNQQFIQQMVQALAGANAPQLPNPEVRFQQQLEQLNAMGFLNREANLQALIATGGDINAAIERLLGSQPS

SEQ ID NO: 68854 - protein, 488 aa, Homo sapiens
MAENGESSGPPRPSRGPAAAQGSAAAPAEPKIIKVTVKTPKEKEEFAVPENSSVQQFKEAISKRFKSQTDQLVLIFAGKILKDQDTLIQHGIHDGLTVHLVIKSQNRPQGQSTQPSNAAGTNTTSASTPRSNSTPISTNSNPFGLGSLGGLAGLSSLGLSSTNFSELQSQMQQQLMASPEMMIQIMENPFVQSMLSNPDLMRQLIMANPQMQQLIQRNPEISHLLNNPDIMRQTLEIARNPAMMQEMMRNQDLALSNLESIPGGYNALRRMYTDIQEPMLNAAQEQFGGNPFASVGSSSSSGEGTQPSRTENRDPLPNPWAPPPATQSSATTSTTTSTGSGSGNSSSNATGNTVAAANYVASIFSTPGMQSLLQQITENPQLIQNMLSAPYMRSMMQSLSQNPDLAAQMMLNSPLFTANPQLQEQMRPQLPAFLQQMQNPDTLSAMSNPTSSSFSKWCRPWLEQMLHSCRIQKSDFSNNWNSSTQWGS

SEQ ID NO: 68855 - protein, 655 aa, Homo sapiens
MAKGGEALPQGSPAPVQDPHLIKVTVKTPKDKEDFSVTDTCTIQQLKEEISQRFKAHPDQLVLIFAGKILKDPDSLAQCGVRDGLTVHLVIKRQHRAMGNECPAASVPTQGPSPGSLPQPSSIYPADGPPAFSLGLLTGLSRLGLAYRGFPDQPSSLMRQHVSVPEFVTQLIDDPFIPGLLSNTGLVRQLVLDNPHMQQLIQHNPEIGHILNNPEIMRQTLEFLRNPAMMQEMIRSQDRVLSNLESIPGGYNVLCTMYTDIMDPMLNAVQEQFGGNPFATATTDNATTTTSQPSRMENCDPLPNPWTSTHGGSGSRQGRQDGDQDAPDIRNRFPNFLGIIRLYDYLQQLHENPQSLGTYLQGTASALSQSQEPPPSVNRVPPSSPSSQEPGSGQPLPEESVAIKGRSSCPAFLRYPTENSTGQGGDQDGAGKSSTGHSTNLPDLVSGLGDSANRVPFAPLSFSPTAAIPGIPEPPWLPSPAYPRSLRPDGMNPAPQLQDEIQPQLPLLMHLQAAMANPRALQALRQIEQGLQVLATEAPRLLLWFMPCLAGTGSVAGGIESREDPLMSEDPLPNPPPEVFPALDSAELGFLSPPFLHMLQDLVSTNPQQLQPEAHFQVQLEQLRSMGFLNREANLQALIATGGDVDAAVEKLRQS

SEQ ID NO: 68856 - protein, 221 aa, Homo sapiens
MAKGGEALPQGSPAPVQDPHLIKVTVKTPKDKEDFSVTDTCTIQQLKEEISQRFKAHPDQLVLIFAGKILKDPDSLAQCGVRDGLTVHLVIKRQHRAMGNECPAASVPTQGPSPGSLPQPSSIYPADGPPAFSLGLLTGLSRLGLAYRGFPDQPSSLMRQHVSVPEFVTQLIDDPFIPGLLSNTGLVRQLVLDNPHMQQLIQHNPEIGHILNNPEIMRQTL

SEQ ID NO: 68857 - protein, 226 aa, Homo sapiens
MAEPSGAETRPPIRVTVKTPKDKEEIVICDRASVKEFKEEISRRFKAQQDQLVLIFAGKILKDGDTLNQHGIKDGLTVHLVIKTPQKAQDPAPPAAPSLPAADAEPRVTLHPYQSPSHAGIAADPAGTTDLADRGPWAGTQPWLLWDIPDPSTLSRQQRRVYARGPHFLTSHASHIFSNRGFQRPAATHAADDPAFGWKWKLTGADARSEISAAAGAAQLHGLHQS

SEQ ID NO: 68858 - protein, 601 aa, Homo sapiens
MAEPSGAETRPPIRVTVKTPKDKEEIVICDRASVKEFKEEISRRFKAQQDQLVLIFAGKILKDGDTLNQHGIKDGLTVHLVIKTPQKAQDPAAATASSPSTPDPASAPSTTPASPATPAQPSTSGSASSDAGSGSRRSSGGGPSPGAGEGSPSATASILSGFGGILGLGSLGLGSANFMELQQQMQRQLMSNPEMLSQIMENPLVQDMMSNPDLMRHMIMANPQMQQLMERNPEISHMLNNPELMRQTMELARNPAMMQEMMRNQDRALSNLESIPGGYNALRRMYTDIQEPMFSAAREQFGNNPFSSLAGNSDSSSSQPLRTENREPLPNPWSPSPPTSQAPGSGGEGTGGSGTSQVHPTVSNPFGINAASLGSGMFNSPEMQALLQQISENPQLMQNVISAPYMRSMMQTLAQNPDFAAQMMVNVPLFAGNPQLQEQLRLQLPVFLQQMQNPESLSILTNPRAMQALLQIQQGLQTLQTEAPGLVPSLGSFGISRTPAPSAGSNAGSTPEAPTSSPATPATSSPTGASSAQQQLMQQMIQLLAGSGNSQVQTPEVRFQQQLEQLNSMGFINREANLQALIATGGDINAAIERLLGSQLS

SEQ ID NO: 68859 - protein, 111 aa, Homo sapiens
MAGKQAVSASGKWLDGIRKWYYNAAGFNKLGLMRDDTIYEDEDVKEAIRRLPENLYNDRMFRIKRALDLNLKHQILPKEQWTKYEEENFYLEPYLKEVIRERKEREEWAKK

SEQ ID NO: 68860 - protein, 480 aa, Homo sapiens
MAASVVCRAATAGAQVLLRARRSPALLRTPALRSTATFAQALQFVPETQVSLLDNGLRVASEQSSQPTCTVGVWIDVGSRFETEKNNGAGYFLEHLAFKGTKNRPGSALEKEVESMGAHLNAYSTREHTAYYIKALSKDLPKAVELLGDIVQNCSLEDSQIEKERDVILREMQENDASMRDVVFNYLHATAFQGTPLAQAVEGPSENVRKLSRADLTEYLSTHYKAPRMVLAAAGGVEHQQLLDLAQKHLGGIPWTYAEDAVPTLTPCRFTGSEIRHRDDALPFAHVAIAVEGPGWASPDNVALQVANAIIGHYDCTYGGGVHLSSPLASGAVANKLCQSFQTFSICYAETGLLGAHFVCDRMKIDDMMFVLQGQWMRLCTSATESEVARGKNILRNALVSHLDGTTPVCEDIGRSLLTYGRRIPLAEWESRIAEVDASVVREICSKYIYDQCPAVAGYGPIEQLPDYNRIRSGMFWLRF

SEQ ID NO: 68861 - protein, 453 aa, Homo sapiens
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSVTATRENMAYTVECLRGDVDILMEFLLNVTTAPEFRRWEVADLQPQLKIDKAVAFQNPQTHVIENLHAAAYRNALANPLYCPDYRIGKVTSEELHYFVQNHFTSARMALIGLGVSHPVLKQVAEQFLNMRGGLGLSGAKANYRGGEIREQNGDSLVHAAFVAESAVAGSAEANAFSVLQHVLGAGPHVKRGSNTTSHLHQAVAKATQQPFDVSAFNASYSDSGLFGIYTISQATAAGDVIKAAYNQVKTIAQGNLSNTDVQAAKNKLKAGYLMSVESSECFLEEVGSQALVAGSYMPPSTVLQQIDSVANADIINAAKKFVSGQKSMAASGNLGHTPFVDEL

SEQ ID NO: 68862 - protein, 91 aa, Homo sapiens
MGLEDEQKMLTESGDPEEEEEEEEELVDPLTTVREQCEQLEKCVKARERLELCDERVSSRSHTEEDCTEELFDFLHARDHCVAHKLFNNLK

SEQ ID NO: 68863 - protein, 82 aa, Homo sapiens
MGREFGNLTRMRHVISYSLSPFEQRAYPHVFTKGIPNVLRRIRESFFRVVPQFVVFYLIYTWGTEEFERSKRKNPAAYENDK

SEQ ID NO: 68864 - protein, 82 aa, Homo sapiens; identical to SEQ ID NO: 68863

SEQ ID NO: 68865 - protein, 82 aa, Homo sapiens; identical to SEQ ID NO: 68863

SEQ ID NO: 68866 - protein, 128 aa, Homo sapiens
MQIFVKTLTGKTITLEVEPSDTIENVKAKIQDKEGIPPDQQRLIFAGKQLEDGRTLSDYNIQKESTLHLVLRLRGGIIEPSLRQLAQKYNCDKMICRKCYARLHPRAVNCRKKKCGHTNNLRPKKKVK

SEQ ID NO: 68867 - protein, 128 aa, Homo sapiens; identical to SEQ ID NO: 68866

SEQ ID NO: 68868 - protein, 623 aa, Homo sapiens
MAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVIREFAMTFATEASLLADCSVKPCTKQLHLTLAHKFYPHHQRTLEQLARAIPLGHSCQWTAALYSRDMRFVHYQTLRALFQYKPQNVDELTLSPGDYIFVDPTQQDEASEGWVIGISQRTGCRGFLPENYTDRASESDTWVKHRMYTFSLATDLNSRKDGEASSRCSGEFLPQTARSLSSLQALQATVARKSVLVVRHGERVDQIFGKAWLQQCSTPDGKYYRPDLNFPCSLPRRSRGIKDFENDPPLSSCGIFQSRIAGDALLDSGIRISSVFASPALRCVQTAKLILEELKLEKKIKIRVEPGIFEWTKWEAGKTTPTLMSLEELKEANFNIDTDYRPAFPLSALMPAESYQEYMDRCTASMVQIVNTCPQDTGVILIVSHGSTLDSCTRPLLGLPPRECGDFAQLVRKIPSLGMCFCEENKEEGKWELVNPPVKTLTHGANAAFNWRNWISGN

SEQ ID NO: 68869 - protein, 661 aa, Homo sapiens
MAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVIREFAMTFATEASLLAGTSVSRFWIFSQVPGHGPNLRLSNLTRASFVSHYILQKYCSVKPCTKQLHLTLAHKFYPHHQRTLEQLARAIPLGHSCQWTAALYSRDMRFVHYQTLRALFQYKPQNVDELTLSPGDYIFVDPTQQDEASEGWVIGISQRTGCRGFLPENYTDRASESDTWVKHRMYTFSLATDLNSRKDGEASSRCSGEFLPQTARSLSSLQALQATVARKSVLVVRHGERVDQIFGKAWLQQCSTPDGKYYRPDLNFPCSLPRRSRGIKDFENDPPLSSCGIFQSRIAGDALLDSGIRISSVFASPALRCVQTAKLILEELKLEKKIKIRVEPGIFEWTKWEAGKTTPTLMSLEELKEANFNIDTDYRPAFPLSALMPAESYQEYMDRCTASMVQIVNTCPQDTGVILIVSHGSTLDSCTRPLLGLPPRECGDFAQLVRKIPSLGMCFCEENKEEGKWELVNPPVKTLTHGANAAFNWRNWISGN

SEQ ID NO: 68870 - protein, 122 aa, Homo sapiens
MAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTGPAV

SEQ ID NO: 68871 - protein, 526 aa, Homo sapiens
MAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVIREFAMTFATEASLLADCSVKPCTKQLHLTLAHKFYPHHQRTLEQLARAIPLGHSCQWTAALYSRDMRFVHYQTLRALFQYKPQNVDELTLSPGDYIFVDPTQQDEASEGWVIGISQRTGCRGFLPENYTDRASESDTWVKHRMYTFSLATDLNSRKDGEASSRCSGEFLPQTARSLSSLQALQATVARKSVLVVRHGERVDQIFGKAWLQQCSTPDGKYYRPDLNFPCSLPRRSRGIKDFENDPPLSSCGIFQSRIAGDALLDSGIRISSVFASPALRCVQTAKLILEELKLEKKIKIRVEPGIFEWTKWEAGKTTPTLMSLEELKEANFNIDTDYRSLPWACASVKKIKRKENGSW

SEQ ID NO: 68872 - protein, 649 aa, Homo sapiens
MAQYGHPSPLGMAAREELYSKVTPRRNRQQRPGTIKHGSALDVLLSMGFPRARAQKALASTGGRSVQAACDWLFSHVGDPFLDDPLPREYVLYLRPTGPLAQKLSDFWQQSKQICGKNKAHNIFPHITLCQFFMCEDSKVDALGEALQTTVSRWKCKFSAPLPLELYTSSNFIGLFVKEDSAEVLKKFAADFAAEAASKTEVHVEPHKKQLHVTLAYHFQASHLPTLEKLAQNIDVKLGCDWVATIFSRDIRFANHETLQVIYPYTPQNDDELELVPGDFIFMSPMEQTSTSEGWIYGTSLTTGCSGLLPENYITKADECSTWIFHGSYSILNTSSSNSLTFGDGVLERRPYEDQGLGETTPLTIICQPMQPLRVNSQPGPQKRCLFVCRHGERMDVVFGKYWLSQCFDAKGRYIRTNLNMPHSLPQRSGGFRDYEKDAPITVFGCMQARLVGEALLESNTIIDHVYCSPSLRCVQTAHNILKGLQQENHLKIRVEPGLFEWTKWVAGSTLPAWIPPSELAAANLSVDTTYRPHIPISKLVVSESYDTYISRSFQVTKEIISECKSKGNNILIVAHASSLEACTCQLQGLSPQNSKDFVQMVRKIPYLGFCSCEELGETGIWQLTDPPILPLTHGPTGGFNWRETLLQE

SEQ ID NO: 68873 - protein, 502 aa, Homo sapiens
MASKKLGADFHGTFSYLDDVPFKTGDKFKTPAKVGLPIGFSLPDCLQVVREVQYDFSLEKKTIEWAEEIKKIEEAEREAECKIAEAEAKVNSKSGPEGDSKMSFSKTHSTATMPPPINPILASLQHNSILTPTRVSSSATKQKVLSPPHIKADFNLADFECEEDPFDNLELKTIDEKEELRNILVGTTGPIMAQLLDNNLPRGGSGSVLQDEEVLASLERATLDFKPLHKPNGFITLPQLGNCEKMSLSSKVSLPPIPAVSNIKSLSFPKLDSDDSNQKTAKLASTFHSTSCLRNGTFQNSLKPSTQSSASELNGHHTLGLSALNLDSGTEMPALTSSQMPSLSVLSVCTEESSPPNTGPTVTPPNFSVSQVPNMPSCPQAYSELQMLSPSERQCVETVVNMGYSYECVLRAMKKKGENIEQILDYLFAHGQLCEKGFDPLLVEEALEMHQCSEEKMMEFLQLMSKFKEMGFELKDIKEVLLLHNNDQDNALEDLMARAGAS

SEQ ID NO: 68874 - protein, 502 aa, Homo sapiens; identical to SEQ ID NO: 68873

SEQ ID NO: 68875 - protein, 441 aa, Homo sapiens
MASKKLGADFHGTFSYLDDVPFKTGDKFKTPAKVGLPIGFSLPDCLQVVREVQYDFSLEKKTIEWAEEIKKIEEAEREAECKIAEAEAKVNSKSGPEGDSKMSFSKTHSTATMPPPINPILASLQHNSILTPTRVSSSATKQKVLSPPHIKADFNLADFECEEDPFDNLELKTIDEKEELRNILVGTTGPIMAQLLDNNLPRGGSGSVLQDEEVLASLERATLDFKPLHKPNGFITLPQLGNCEKMSLSSKVSLPPIPAVSNIKSLSFPKLDSDDSNQKTAKLASTFHSTSCLRNGTFQNSLKPSTQSSASELNGHHTLGLSALNLDSGTEMPALTSSQMPSLSVLSVCTEESSPPNTGPTILDYLFAHGQLCEKGFDPLLVEEALEMHQCSEEKMMEFLQLMSKFKEMGFELKDIKEVLLLHNNDQDNALEDLMARAGAS

SEQ ID NO: 68876 - protein, 502 aa, Homo sapiens; identical to SEQ ID NO: 68873

SEQ ID NO: 68877 - protein, 502 aa, Homo sapiens; identical to SEQ ID NO: 68873

SEQ ID NO: 68878 - protein, 538 aa, Homo sapiens
MSGAVRGRRREVGLQHGGCGTGGGYGDGLARSGQSWRWWRSLSLGAVGSSAGTEPGRPAGASTFRLLRRRQQRHSGSKWLLRSWVQIFMYDFSLEKKTIEWAEEIKKIEEAEREAECKIAEAEAKVNSKSGPEGDSKMSFSKTHSTATMPPPINPILASLQHNSILTPTRVSSSATKQKVLSPPHIKADFNLADFECEEDPFDNLELKTIDEKEELRNILVGTTGPIMAQLLDNNLPRGGSGSVLQDEEVLASLERATLDFKPLHKPNGFITLPQLGNCEKMSLSSKVSLPPIPAVSNIKSLSFPKLDSDDSNQKTAKLASTFHSTSCLRNGTFQNSLKPSTQSSASELNGHHTLGLSALNLDSGTEMPALTSSQMPSLSVLSVCTEESSPPNTGPTVTPPNFSVSQVPNMPSCPQAYSELQMLSPSERQCVETVVNMGYSYECVLRAMKKKGENIEQILDYLFAHGQLCEKGFDPLLVEEALEMHQCSEEKMMEFLQLMSKFKEMGFELKDIKEVLLLHNNDQDNALEDLMARAGAS

SEQ ID NO: 68879 - protein, 566 aa, Homo sapiens
MSGAVRGRRREVGLQHGGCGTGGGYGDGLARSGQSWRWWRSLSLGAVGSSAGTEPGRPAGASTFRLLRRRQQRHSGTFSYLDDVPFKTGDKFKTPAKVGLPIGFSLPDCLQVVREVQYDFSLEKKTIEWAEEIKKIEEAEREAECKIAEAEAKVNSKSGPEGDSKMSFSKTHSTATMPPPINPILASLQHNSILTPTRVSSSATKQKVLSPPHIKADFNLADFECEEDPFDNLELKTIDEKEELRNILVGTTGPIMAQLLDNNLPRGGSGSVLQDEEVLASLERATLDFKPLHKPNGFITLPQLGNCEKMSLSSKVSLPPIPAVSNIKSLSFPKLDSDDSNQKTAKLASTFHSTSCLRNGTFQNSLKPSTQSSASELNGHHTLGLSALNLDSGTEMPALTSSQMPSLSVLSVCTEESSPPNTGPTVTPPNFSVSQVPNMPSCPQAYSELQMLSPSERQCVETVVNMGYSYECVLRAMKKKGENIEQILDYLFAHGQLCEKGFDPLLVEEALEMHQCSEEKMMEFLQLMSKFKEMGFELKDIKEVLLLHNNDQDNALEDLMARAGAS

SEQ ID NO: 68880 - protein, 229 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGC

SEQ ID NO: 68881 - protein, 229 aa, Homo sapiens; identical to SEQ ID NO: 68880

SEQ ID NO: 68882 - protein, 229 aa, Homo sapiens; identical to SEQ ID NO: 68880

SEQ ID NO: 68883 - protein, 153 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGC

SEQ ID NO: 68884 - protein, 685 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPSDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 68885 - protein, 149 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRL

SEQ ID NO: 68886 - protein, 123 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAG

SEQ ID NO: 68887 - protein, 685 aa, Homo sapiens; identical to SEQ ID NO: 68884

SEQ ID NO: 68888 - protein, 161 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLT

SEQ ID NO: 68889 - protein, 134 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSD

SEQ ID NO: 68890 - protein, 169 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPSDQQRLIFAGKQLEDGRTLSDYNIQKESTLHLVLRLRGGMQIFVKTLTGKTITLEV

SEQ ID NO: 68891 - protein, 155 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQI

SEQ ID NO: 68892 - protein, 61 aa, Homo sapiens
MQIFVKTLTGKTITLEVEPSDTIENVKAKIQDKEGIPPDQQRLIFAGKQLEDGRTLSDYNI

SEQ ID NO: 68893 - protein, 609 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPSDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 68894 - protein, 136 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYN

SEQ ID NO: 68895 - protein, 223 aa, Homo sapiens [sequence omitted]

SEQ ID NO: 68896 - protein, 213 aa, Homo sapiens
MQLKPMEINPEMLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRVDDKVNFHFILFNNVDGHLYELDGRMPFPVNHGASSEDTLLKDAAKVCREFTEREQGEVR

SEQ ID NO: 68897 - protein, 58 aa, Homo sapiens
MQLKPMEINPEMLNKVLSRLGVAGQWRFVDVLGLEEESLGSVPAPACALLLLFPLTAQ

SEQ ID NO: 68898 - protein, 251 aa, Homo sapiens
MVPRPVCAVLLLFPITEKYEVFRTEEEEKIKSQGQDVTSSVYFMKQTISNACGTIGLIHAIANNKDKMHFESGSTLKKFLEESVSMSPEERARYLENYDAIRVTHETSAHEGQTESSSPSSSQPHSSHCRTKASSLCHHASLPWVKRNHVGPAKATSPSLRLRRWRPFLRLPSLGLHSVAPSIDEKVDLHFIALVHVDGHLYELDGRKPFPINHGETSDETLLEDAIEVCKKFMERDPDELRFNAIALSAA

SEQ ID NO: 68899 - protein, 230 aa, Homo sapiens
MEGQRWLPLEANPEVTNQFLKQLGLHPNWQFVDVYGMDPELLSMVPRPVCAVLLLFPITEKYEVFRTEEEEKIKSQGQDVTSSVYFMKQTISNACGTIGLIHAIANNKDKMHFESGSTLKKFLEESVSMSPEERARYLENYDAIRVTHETSAHEGQTEAPSIDEKVDLHFIALVHVDGHLYELDGRKPFPINHGETSDETLLEDAIEVCKKFMERDPDELRFNAIALSAA

SEQ ID NO: 68900 - protein, 228 aa, Homo sapiens
TEEEEKIKSQGQDVTSSVYFMKQTISNACGTIGLIHAIANNKDKMHFESGSTLKKFLEESVSMSPEERARYLENYDAIRVTHETSAHEGQTESSSPSSSQPHSSHCRTKASSLCHHASLPWVKRNHVGPAKATSPSLRLRRWRPFLRLPSLGLHSVAPSIDEKVDLHFIALVHVDGHLYELDGRKPFPINHGETSDETLLEDAIEVCKKFMERDPDELRFNAIALSAA

SEQ ID NO: 68901 - protein, 326 aa, Homo sapiens
MTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKFEKHFEKTLLGK

SEQ ID NO: 68902 - protein, 316 aa, Homo sapiens
MTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKGK

SEQ ID NO: 68903 - protein, 368 aa, Homo sapiens
ARGGSGRCVARAMTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKDGFSPCCPGWSQTPELKPSACLDLPKWYSEGEIRFNLMAIVSDRKMIYEQKIAELQRQLAEEEPMDTDQGNSMLSAIQSEVAKNQMLIEEEVQKLKRYKIENIRRKHNYLPFIMELLKTLAEHQQLIPLVEKAKEKQNAKKAQETK

SEQ ID NO: 68904 - protein, 355 aa, Homo sapiens
MTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKDGFSPCCPGWSQTPELKPSACLDLPKWYSEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKAKEKQNAKKAQETK

SEQ ID NO: 68905 - protein, 192 aa, Homo sapiens
MKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKIF

SEQ ID NO: 68906 - protein, 328 aa, Homo sapiens
MTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKAKEKQNAKKAQETK

SEQ ID NO: 68907 - protein, 329 aa, Homo sapiens
MTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEEPMDTDQGNSMLSAIQSEVAKNQMLIEEEVQKLKRYKIENIRRKHNYLPFIMELLKTLAEHQQLIPLVEKAKEKQNAKKAQETK

SEQ ID NO: 68908 - protein, 317 aa, Homo sapiens
MESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEEPMDTDQGNSMLSAIQSEVAKNQMLIEEEVQKLKRYKIENIRRKHNYLPFIMELLKTLAEHQQLIPLVEKFEKHFEKTLLGK

SEQ ID NO: 68909 - protein, 99 aa, Homo sapiens
  MOD_RES (1)..(1): Any amino acid
XNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKIF

SEQ ID NO: 68910 - protein, 165 aa, Homo sapiens
MVRPGLARMSLPRCWFRYPGWTGAEAGRGRAIVSRRLPSLNPWDAGERHGGLVRICASLGPHKRLPAGLPQCPHLYLAADPLDPQRRQEKSCAALGNDKRRQPDGQRQPQQQQQPHCRRGFQAPALPNPLRVLQGLGRVSMSLGWLERPPALSRAAGCRGAQVEE

SEQ ID NO: 68911 - protein, 218 aa, Homo sapiens
  MOD_RES (1)..(1): Any amino acid
XLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEEPMDTDQGNSMLSAIQSEVAKNQMLIEEEVQKLKRYKIENIRRKHNYLPFIMELLKTLAEHQQLIPLVEKFEKHFEKTLLGK

SEQ ID NO: 68912 - protein, 258 aa, Homo sapiens
MSLGWLERPPALSRAAGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEPMDTDQGNSMLSAIQSEVAKNQ

SEQ ID NO: 68913 - protein, 183 aa, Homo sapiens
  MOD_RES (1)..(1): Any amino acid
XQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEEPMDTDQGNSMLSAIQSEVAKNQMLIEEEVQKLKRYKIENIRRKHNYLPFIMELLKTLAEHQQLIPLVEKFEKHFEKTLLGK

SEQ ID NO: 68914 - protein, 115 aa, Homo sapiens
  MOD_RES (1)..(1): Any amino acid
XEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKFEKHFEKTLLGK

SEQ ID NO: 68915 - protein, 193 aa, Homo sapiens
MKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEEPMDTDQGNSMLSAIQSEVAKNQMLIEEEVQKLKRYKIENIRRKHNYLPFIMELLKTLAEHQQLIPLVEKIF

SEQ ID NO: 68916 - protein, 165 aa, Homo sapiens
MAPNASCLCVHVRSEEWDLMTFDANPYDSVKKIKEHVRSKTKVPVQDQVLLLGSKILKPRRSLSSYGIDKEKTIHLTLKVVKPSDEELPLFLVESGDEAKRHLLQVRRSSSVAQVKAMIETKTGIIPETQIVTCNGKRLEDGKMMADYGIRKGNLLFLACYCIGG

SEQ ID NO: 68917 - protein, 165 aa, Homo sapiens
MAPNASCLCVHVRSEEWDLMTFDANPYDSVKKIKEHVRSKTKVPVQDQVLLLGSKILKPRRSLSSYGIDKEKTIHLTLKVVKPSDEELPLFLVESGDEAKRHLLQVRRSSSVAQVKAMIETKTGIIPETQIVTCNGKRLEDGKMMADYGIRKGNLLFLASYCIGG

SEQ ID NO: 68918 - protein, 165 aa, Homo sapiens
MAPNASCLCVHVRSEEWDLMTFDANPYDSVKKIKEHVRSKTKVPVQDQVLLLGSKILKPRRSLSSYGTDKEKTIHLTLKVVKPSDEELPLFLVESGDEAKRHLLQVRRSSSVAQVKAMIETKTGIIPETQIVTCNGKRLEDGKMMADYGIRKGNLLFLASYCIGG

SEQ ID NO: 68919 - protein, 165 aa, Homo sapiens; identical to SEQ ID NO: 68918

SEQ ID NO: 68920 - protein, 165 aa, Homo sapiens; identical to SEQ ID NO: 68916

SEQ ID NO: 68921 - protein, 165 aa, Homo sapiens; identical to SEQ ID NO: 68918

SEQ ID NO: 68922 - protein, 165 aa, Homo sapiens; identical to SEQ ID NO: 68917

SEQ ID NO: 68923 - protein, 234 aa, Homo sapiens
MGGCVGAQHDSSGSLNENSEGTGVALGRNQPLKKEKPKWKSDYPMTDGQLRSKRDEFWDTAPAFEGRKEIWDALKAAAHAFESNDHELAQAIIDGANITLPHGALTECYDELGNRYQLPVYCLAPPINMIEEKSDIETLDIPEPPPNSGYECQLRLRLSTGKDLKLVVRSTDTVFHMKRRLHAAEGVEPGSQRWFFSGRPLTDKMKFEELKIPKDYVVQVIVSQPVQNPTPVEN

SEQ ID NO: 68924 - protein, 307 aa, Homo sapiens
MFSFNMFDHPIPRVFQNRFSTQYRCFSVSMLAGPNDRSDVEKGGKIIMPPSALDQLSRLNITYPMLFKLTNKNSDRMTHCGVLEFVADEGICYLPHWMMQNLLLEEGGLVQVESVNLQVATYSKFQPQSPDFLDITNPKAVLENALRNFACLTTGDVIAINYNEKIYELRVMETKPDKAVSIIECDMNVDFDAPLGYKEPERQVQHEESTEGEADHSGYAGELGFRAFSGSGNRLDGKKKGVEPSPSPIKPGDIKRGIPNYEFKLGKITFIRNSRPLVKKVEEDEAGGRFVAFSGEGQSLRKKGRKP

SEQ ID NO: 68925 - protein, 296 aa, Homo sapiens
MFSFNMFDHPIPRVFQNRFSTQYRCFSVSMLAGPNDRSDVEKGGKSRLNITYPMLFKLTNKNSDRMTHCGVLEFVADEGICYLPHWMMQNLLLEEGGLVQVESVNLQVATYSKFQPQSPDFLDITNPKAVLENALRNFACLTTGDVIAINYNEKIYELRVMETKPDKAVSIIECDMNVDFDAPLGYKEPERQVQHEESTEGEADHSGYAGELGFRAFSGSGNRLDGKKKGVEPSPSPIKPGDIKRGIPNYEFKLGKITFIRNSRPLVKKVEEDEAGGRFVAFSGEGQSLRKKGRKP

SEQ ID NO: 68926 - protein, 343 aa, Homo sapiens
MFSFNMFDHPIPRVFQNRFSTQYRCFSVSMLAGPNDRSDVEKGGKIIMPPSALDQLSRLNITYPMLFKLTNKNSDRMTHCGVLEFVADEGICYLPHWVVYRLSLERDGLKSLEVAEVSGSDYFPSPFCGLEVWMMQNLLLEEGGLVQVESVNLQVATYSKFQPQSPDFLDITNPKAVLENALRNFACLTTGDVIAINYNEKIYELRVMETKPDKAVSIIECDMNVDFDAPLGYKEPERQVQHEESTEGEADHSGYAGELGFRAFSGSGNRLDGKKKGVEPSPSPIKPGDIKRGIPNYEFKLGKITFIRNSRPLVKKVEEDEAGGRFVAFSGEGQSLRKKGRKP

SEQ ID NO: 68927 - protein, 266 aa, Homo sapiens
MFSFNMFDHPIPRVFQNRFSTQYRCFSVSMLAGPNDRSDVEKGGKIIMPPSALDQLSRLNITYPMLFKLTNKNSDRMTHCGVLEFVADEGICYLPHWMMQNLLLEEGGLVQVESVNLQVATYSKFQPQSPDFLDITNPKAVLENALRNFACLTTGDVIAINYNEKIYELRVMETKPDKAVSIIECDMNVDFDAPLGYKEPERQVQHEESTEGEADHSGYAGELGFRAFSGSGNRLDGKKKGVEPSPSPIKPGDIKRGIPNYEFKLG

SEQ ID NO: 68928 - protein, 350 aa, Homo sapiens
MLPLPDLDLWPLDRLPSPIKRKPQTLGSLKSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTEVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 68929 - protein, 720 aa, Homo sapiens
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQESTGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNECISEDMGDEDKEERQESRASDWHSKTKDFQESSIKSLKEKLLLEEEPTTSHGQSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTEVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 68930 - protein, 642 aa, Homo sapiens
MTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQESTGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNECISEDMGDEDKEERQESRASDWHSKTKDFQESSIKSLKEKLLLEEEPTTSHGQSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTEVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 68931 - protein, 719 aa, Homo sapiens
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQESTGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNECISEDMGDEDKEERQESRASDWHSKTKDFQESSIKSLKEKLLLEEEPTTSHGQSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 68932 - protein, 31 aa, Homo sapiens
MPRRKKKVKEVSESRNLEKKDVETTSSVSVK

SEQ ID NO: 68933 - protein, 89 aa, Homo sapiens
MPRRKKKVKEVSESRNLEKKDVETTSSVSVKRKRRLEDAFIVISDSDGEEPKEENGLQKTKTKQSNRAKCLAKRKIAQMTEEEQFALAL

SEQ ID NO: 68934 - protein, 157 aa, Homo sapiens
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIW

SEQ ID NO: 68935 - protein, 719 aa, Homo sapiens; identical to SEQ ID NO: 68931

SEQ ID NO: 68936 - protein, 1749 aa, Homo sapiens
MADEEAGGTERMEISAELPQTPQRLASWWDQQVDFYTAFLHHLAQLVPEIYFAEMDPDLEKQEESVQMSIFTPLEWYLFGEDPDICLEKLKHSGAFQLCGRVFKSGETTYSCRDCAIDPTCVLCMDCFQDSVHKNHRYKMHTSTGGGFCDCGDTEAWKTGPFCVNHEPGRAGTIKENSRCPLNEEVIVQARKIFPSVIKYVVEMTIWEEEKELPPELQIREKNERYYCVLFNDEHHSYDHVIYSLQRALDCELAEAQLHTTAIDKEGRRAVKAGAYAACQEAKEDIKSHSENVSQHPLHVEVLHSEIMAHQKFALRLGSWMNKIMSYSSDFRQIFCQACLREEPDSENPCLISRLMLWDAKLYKGARKILHELIFSSFFMEMEYKKLFAMEFVKYYKQLQKEYISDDHDRSISITALSVQMFTVPTLARHLIEEQNVISVITETLLEVLPEYLDRNNKFNFQGYSQDKLGRVYAVICDLKYILISKPTIWTERLRMQFLEGFRSFLKILTCMQGMEEIRRQVGQHIEVDPDWEAAIAIQMQLKNILLMFQEWCACDEELLLVAYKECHKAVMRCSTSFISSSKTVVQSCGHSLETKSYRVSEDLVSIHLPLSRTLAGLHVRLSRLGAVSRLHEFVSFEDFQVEVLVEYPLRCLVLVAQVVAEMWRRNGLSLISQVFYYQDVKCREEMYDKDIIMLQIGASLMDPNKFLLLVLQRYELAEAFNKTISTKDQDLIKQYNTLIEEMLQVLIYIVGERYVPGVGNVTKEEVTMREIIHLLCIEPMPHSAIAKNLPENENNETGLENVINKVATFKKPGVSGHGVYELKDESLKDFNMYFYHYSKTQHSKAEHMQKKRRKQENKDEALPPPPPPEFCPAFSKVINLLNCDIMMYILRTVFERAIDTDSNLWTEGMLQMAFHILALGLLEEKQQLQKAPEEEVTFDFYHKASRLGSSAMNIQMLLEKLKGIPQLEGQKDMITWILQMFDTVKRLREKSCLIVATTSGSESIKNDEITHDKEKAERKRKAEAARLHRQKIMAQMSALQKNFIETHKLMYDNTSEMPGKEDSIMEEESTPAVSDYSRIALGPKRGPSVTEKEVLTCILCQEEQEVKIENNAMVLSACVQKSTALTQHRGKPIELSGEALDPLFMDPDLAYGTYTGSCGHVMHAVCWQKYFEAVQLSSQQRIHVDLFDLESGEYLCPLCKSLCNTVIPIIPLQPQKINSENADALAQLLTLARWIQTVLARISGYNIRHAKGENPIPIFFNQGMGDSTLEFHSILSFGVESSIKYSNSIKEMVILFATTIYRIGLKVPPDERDPRVPMLTWSTCAFTIQAIENLLGDEGKPLFGALQNRQHNGLKALMQFAVAQRITCPQVLIQKHLVRLLSVVLPNIKSEDTPCLLSIDLFHVLVGAVLAFPSLYWDDPVDLQPSSVSSSYNHLYLFHLITMAHMLQILLTVDTGLPLAQVQEDSEEAHSASSFFAEISQYTSGSIGCDIPGWYLWVSLKNGITPYLRCAALFFHYLLGVTPPEELHTNSAEGEYSALCSYLSLPTNLFLLFQEYWDTVRPLLQRWCADPALLNCLKQKNTVVRYPRKRNSLIELPDDYSCLLNQASHFRCPRSADDERKHPVLCLFCGAILCSQNICCQEIVNGEEVGACIFHALHCGAGVCIFLKIRECRVVLVEGKARGCAYPAPYLDEYGETDPGLKRGNPLHLSRERYRKLHLVWQQHCIIEEIARSQETNQMLFGFNWQLL

SEQ ID NO: 68937 - protein, 803 aa, Homo sapiens
MADEEAGGTERMEISAELPQTPQRLASWWDQQVDFYTAFLHHLAQLVPEIYFAEMDPDLEKQEESVQMSIFTPLEWYLFGEDPDICLEKLKHSGAFQLCGRVFKSGETTYSCRDCAIDPTCVLCMDCFQDSVHKNHRYKMHTSTGGGFCDCGDTEAWKTGPFCVNHEPGRAGTIKENSRCPLNEEVIVQARKIFPSVIKYVVEMTIWEEEKELPPELQIREKNERYYCVLFNDEHHSYDHVIYSLQRALDCELAEAQLHTTAIDKEGRRAVKAGAYAACQEAKEDIKSHSENVSQHPLHVEVLHSEIMAHQKFALRLGSWMNKIMSYSSDFRQIFCQACLREEPDSENPCLISRLMLWDAKLYKGARKILHELIFSSFFMEMEYKKLFAMEFVKYYKQLQKEYISDDHDRSISITALSVQMFTVPTLARHLIEEQNVISVITETLLEVLPEYLDRNNKFNFQGYSQDKLGRVYAVICDLKYILISKPTIWTERLRMQFLEGFRSFLKILTCMQGMEEIRRQVGQHIEVDPDWEAAIAIQMQLKNILLMFQEWCACDEELLLVAYKECHKAVMRCSTSFISSSKTVVQSCGHSLETKSYRVSEDLVSIHLPLSRTLAGLHVRLSRLGAVSRLHEFVSFEDFQVEVLVEYPLRCLVLVAQVVAEMWRRNGLSLISQVFYYQDVKCREEMYDKDIIMLQIGASLMDPNKFLLLVLQRYELAEAFNKTISTKDQDLIKQYNTLIEEMLQVLIYIVGERYVPGVGNVTKEEVTMREIIHLLCIEPMPHSAIAKNLPENETRCIRPWSL

SEQ ID NO: 68938 - protein, 1013 aa, Homo sapiens
MADEEAGGTERMEISAELPQTPQRLASWWDQQVDFYTAFLHHLAQLVPEIYFAEMDPDLEKQEESVQMSIFTPLEWYLFGEDPDICLEKLKHSGAFQLCGRVFKSGETTYSCRDCAIDPTCVLCMDCFQDSVHKNHRYKMHTSTGGGFCDCGDTEAWKTGPFCVNHEPGRAGTIKENSRCPLNEEVIVQARKIFPSVIKYVVEMTIWEEEKELPPELQIREKNERYYCVLFNDEHHSYDHVIYSLQRALDCELAEAQLHTTAIDKEGRRAVKAGAYAACQEAKEDIKSHSENVSQHPLHVEVLHSEIMAHQKFALRLGSWMNKIMSYSSDFRQIFCQACLREEPDSENPCLISRLMLWDAKLYKGARKILHELIFSSFFMEMEYKKLFAMEFVKYYKQLQKEYISDDHDRSISITALSVQMFTVPTLARHLIEEQNVISVITETLLEVLPEYLDRNNKFNFQGYSQDKLGRVYAVICDLKYILISKPTIWTERLRMQFLEGFRSFLKILTCMQGMEEIRRQVGQHIEVDPDWEAAIAIQMQLKNILLMFQEWCACDEELLLVAYKECHKAVMRCSTSFISSSKTVVQSCGHSLETKSYRVSEDLVSIHLPLSRTLAGLHVRLSRLGAVSRLHEFVSFEDFQVEVLVEYPLRCLVLVAQVVAEMWRRNGLSLISQVFYYQDVKCREEMYDKDIIMLQIGASLMDPNKFLLLVLQRYELAEAFNKTISTKDQDLIKQYNTLIEEMLQVLIYIVGERYVPGVGNVTKEEVTMREIIHLLCIEPMPHSAIAKNLPENENNETGLENVINKVATFKKPGVSGHGVYELKDESLKDFNMYFYHYSKTQHSKAEHMQKKRRKQENKDEALPPPPPPEFCPAFSKVINLLNCDIMMYILRTVFERAIDTDSNLWTEGMLQMAFHILALGLLEEKQQLQKAPEEEVTFDFYHKASRLGSSAMNIQMLLEKLKGIPQLEGQKDMITWILQMFDTVKRLREKSCLIVATTSGSESIKNDEILHH

SEQ ID NO: 68939 - protein, 575 aa, Homo sapiens
MYAGNIPIYKTESRSRNEQGMDPITRQVGQHIEMEPEWEAAFTLQMKLTHVISMMQDWCASDEKVLIEAYKKCLAVLMQCHGGYTDGEQPITLSICGHSVETIRYCVSQEKVSIHLPVSRLLAGLHVLLSKSEVAYKFPELLPLSELSPPMLIEHPLRCLVLCAQVHAGMWRRNGFSLVNQIYYYHNVKCRREMFDKDVVMLQTGVSMMDPNHFLMIMLSRFELYQIFSTPDYGKRFSSEITHKDVVQQNNTLIEEMLYLIIMLVGERFSPGVGQVNATDEIKREIIHQLSIKPMAHSELVKSLPEDENKETGMESVIEAVAHFKKPGLTGRGMYELKPECAKEFNLYFYHFSRAEQSKAEEAQRKLKRQNREDTALPPPVLPPFCPLFASLVNILQSDVMLCIMGTILQWAVEHNGYAWSESMLQRVLHLIGMALQEEKQHLENVTEEHVVTFTFTQKISKPGEAPKNSPSILAMLETLQNAPYLEVHKDMIRWILKTFNAVKKMRESSPTSPVAETEGTIMEEHNFRVQGTKTKLRGREKQRLPDCAEKRSWLRCLKCSGILLMKTKNSFSRH

SEQ ID NO: 68940 - protein, 1755 aa, Homo sapiens
MASELEPEVQAIDRSLLECSAEEIAGKWLQATDLTREVYQHLAHYVPKIYCRGPNPFPQKEDMLAQHVLLGPMEWYLCGEDPAFGFPKLEQANKPSHLCGRVFKVGEPTYSCRDCAVDPTCVLCMECFLGSIHRDHRYRMTTSGGGGFCDCGDTEAWKEGPYCQKHELNTSEIEEEEDPLVHLSEDVIARTYNIFAITFRYAVEILTWEKESELPADLEMVEKSDTYYCMLFNDEVHTYEQVIYTLQKAVNCTQKEAIGFATTVDRDGRRSVRYGDFQYCEQAKSVIVRNTSRQTKPLKVQVMHSSIVAHQNFGLKLLSWLGSIIGYSDGLRRILCQVGLQEGPDGENSSLVDRLMLSDSKLWKGARSVYHQLFMSSLLMDLKYKKLFAVRFAKNYQQLQRDFMEDDHERAVSVTALSVQFFTAPTLARMLITEENLMSIIIKTFMDHLRHRDAQGRFQFERYTALQAFKFRRVQSLILDLKYVLISKPTEWSDELRQKFLEGFDAFLELLKCMQGMDPITRQVGQHIEMEPEWEAAFTLQMKLTHVISMMQDWCASDEKVLIEAYKKCLAVLMQCHGGYTDGEQPITLSICGHSVETIRYCVSQEKVSIHLPVSRLLAGLHVLLSKSEVAYKFPELLPLSELSPPMLIEHPLRCLVLCAQVHAGMWRRNGFSLVNQIYYYHNVKCRREMFDKDVVMLQTGVSMMDPNHFLMIMLSRFELYQIFSTPDYGKRFSSEITHKDVVQQNNTLIEEMLYLIIMLVGERFSPGVGQVNATDEIKREIIHQLSIKPMAHSELVKSLPEDENKETGMESVIEAVAHFKKPGLTGRGMYELKPECAKEFNLYFYHFSRAEQSKAEEAQRKLKRQNREDTALPPPVLPPFCPLFASLVNILQSDVMLCIMGTILQWAVEHNGYAWSESMLQRVLHLIGMALQEEKQHLENVTEEHVVTFTFTQKISKPGEAPKNSPSILAMLETLQNAPYLEVHKDMIRWILKTFNAVKKMRESSPTSPVAETEGTIMEESSRDKDKAERKRKAEIARLRREKIMAQMSEMQRHFIDENKELFQQTLELDASTSAVLDHSPVASDMTLTALGPAQTQVPEQRQFVTCILCQEEQEVKVESRAMVLAAFVQRSTVLSKNRSKFIQDPEKYDPLFMHPDLSCGTHTSSCGHIMHAHCWQRYFDSVQAKEQRRQQRLRLHTSYDVENGEFLCPLCECLSNTVIPLLLPPRNIFNNRLNFSDQPNLTQWIRTISQQIKALQFLRKEESTPNNASTKNSENVDELQLPEGFRPDFRPKIPYSESIKEMLTTFGTATYKVGLKVHPNEEDPRVPIMCWGSCAYTIQSIERILSDEDKPLFGPLPCRLDDCLRSLTRFAAAHWTVASVSVVQGHFCKLFASLVPNDSHEELPCILDIDMFHLLVGLVLAFPALQCQDFSGISLGTGDLHIFHLVTMAHIIQILLTSCTEENGMDQENPPCEEESAVLALYKTLHQYTGSALKEIPSGWHLWRSVRAGIMPFLKCSALFFHYLNGVPSPPDIQVPGTSHFEHLCSYLSLPNNLICLFQENSEIMNSLIESWCRNSEVKRYLEGERDAIRYPRESNKLINLPEDYSSLINQASNFSCPKSGGDKSRAPTLCLVCGSLLCSQSYCCQTELEGEDVGACTAHTYSCGSGVGIFLRVRECQVLFLAGKTKGCFYSPPYLDDYGETDQGLRRGNPLHLCKERFKKIQKLWHQHSVTEEIGHAQEANQTLVGIDWQHL

SEQ ID NO: 68941 - protein, 1755 aa, Homo sapiens
MASELEPEVQAIDRSLLECSAEEIAGKWLQATDLTREVYQHLAHYVPKIYCRGPNPFPQKEDMLAQHVLLGPMEWYLCGEDPAFGFPKLEQANKPSHLCGRVFKVGEPTYSCRDCAVDPTCVLCMECFLGSIHRDHRYRMTTSGGGGFCDCGDTEAWKEGPYCQKHELNTSEIEEEEDPLVHLSEDVIARTYNIFAITFRYAVEILTWEKESELPADLEMVEKSDTYYCMLFNDEVHTYEQVIYTLQKAVNCTQKEAIGFATTVDRDGRRSVRYGDFQYCEQAKSVIVRNTSRQTKPLKVQVMHSSIVAHQNFGLKLLSWLGSIIGYSDGLRRILCQVGLQEGPDGENSSLVDRLMLSDSKLWKGARSVYHQLFMSSLLMDLKYKKLFAVRFAKNYERLQSDYVTDDHDREFSVADLSVQIFTVPSLARMLITEENLMSIIIKTFMDHLRHRDAQGRFQFERYTALQAFKFRRVQSLILDLKYVLISKPTEWSDELRQKFLEGFDAFLELLKCMQGMDPITRQVGQHIEMEPEWEAAFTLQMKLTHVISMMQDWCASDEKVLIEAYKKCLAVLMQCHGGYTDGEQPITLSICGHSVETIRYCVSQEKVSIHLPVSRLLAGLHVLLSKSEVAYKFPELLPLSELSPPMLIEHPLRCLVLCAQVHAGMWRRNGFSLVNQIYYYHNVKCRREMFDKDVVMLQTGVSMMDPNHFLMIMLSRFELYQIFSTPDYGKRFSSEITHKDVVQQNNTLIEEMLYLIIMLVGERFSPGVGQVNATDEIKREIIHQLSIKPMAHSELVKSLPEDENKETGMESVIEAVAHFKKPGLTGRGMYELKPECAKEFNLYFYHFSRAEQSKAEEAQRKLKRQNREDTALPPPVLPPFCPLFASLVNILQSDVMLCIMGTILQWAVEHNGYAWSESMLQRVLHLIGMALQEEKQHLENVTEEHVVTFTFTQKISKPGEAPKNSPSILAMLETLQNAPYLEVHKDMIRWILKTFNAVKKMRESSPTSPVAETEGTIMEESSRDKDKAERKRKAEIARLRREKIMAQMSEMQRHFIDENKELFQQTLELDASTSAVLDHSPVASDMTLTALGPAQTQVPEQRQFVTCILCQEEQEVKVESRAMVLAAFVQRSTVLSKNRSKFIQDPEKYDPLFMHPDLSCGTHTSSCGHIMHAHCWQRYFDSVQAKEQRRQQRLRLHTSYDVENGEFLCPLCECLSNTVIPLLLPPRNIFNNRLNFSDQPNLTQWIRTISQQIKALQFLRKEESTPNNASTKNSENVDELQLPEGFRPDFRPKIPYSESIKEMLTTFGTATYKVGLKVHPNEEDPRVPIMCWGSCAYTIQSIERILSDEDKPLFGPLPCRLDDCLRSLTRFAAAHWTVASVSVVQGHFCKLFASLVPNDSHEELPCILDIDMFHLLVGLVLAFPALQCQDFSGISLGTGDLHIFHLVTMAHIIQILLTSCTEENGMDQENPPCEEESAVLALYKTLHQYTGSALKEIPSGWHLWRSVRAGIMPFLKCSALFFHYLNGVPSPPDIQVPGTSHFEHLCSYLSLPNNLICLFQENSEIMNSLIESWCRNSEVKRYLEGERDAIRYPRESNKLINLPEDYSSLINQASNFSCPKSGGDKSRAPTLCLVCGSLLCSQSYCCQTELEGEDVGACTAHTYSCGSGVGIFLRVRECQVLFLAGKTKGCFYSPPYLDDYGETDQGLRRGNPLHLCKERFKKIQKLWHQHSVTEEIGHAQEANQTLVGIDWQHL

SEQ ID NO: 68942 - protein, 439 aa, Homo sapiens
MASELEPEVQAIDRSLLECSAEEIAGKWLQATDLTREVYQHLAHYVPKIYCRGPNPFPQKEDMLAQHVLLGPMEWYLCGEDPAFGFPKLEQANKPSHLCGRVFKVGEPTYSCRDCAVDPTCVLCMECFLGSIHRDHRYRMTTSGGGGFCDCGDTEAWKEGPYCQKHELNTSEIEEEEDPLVHLSEDVIARTYNIFAITFRYAVEILTWEKESELPADLEMVEKSDTYYCMLFNDEVHTYEQVIYTLQKAVNCTQKEAIGFATTVDRDGRRSVRYGDFQYCEQAKSVIVRNTSRQTKPLKVQVMHSSIVAHQNFGLKLLSWLGSIIGYSDGLRRILCQVGLQEGPDGENSSLVDRLMLSDSKLWKGARSVYHQLFMSSLLMDLKYKKLFAVRFAKNYERLQSDYVTDDHDREFSVADLSVQIFTVPSLFSISAGRSGSPL

SEQ ID NO: 68943 - protein, 1888 aa, Homo sapiens
MAAAAAAAVGGQQPSQPELPAPGLALDKAATAAHLKAALSRPDNRAGAEELQALLERVLSAERPLAAAAGGEDAAAAGGGGGPGAAEEEALEWCKCLLAGGGGYDEFCAAVRAYDPAALCGLVWTANFVAYRCRTCGISPCMSLCAECFHQGDHTGHDFNMFRSQAGGACDCGDSNVMRESGFCKRHQIKSSSNIPCVPKDLLMMSEFVLPRFIFCLIQYLREGYNEPAADGPSEKDLNKVLQLLEPQISFLEDLTKMGGAMRSVLTQVLTNQQNYKDLTSGLGENACVKKSHEKYLIALKSSGLTYPEDKLVYGVQEPSAGTSSLAVQGFIGATGTLGQVDSSDEDDQDGSQGLGKRKRVKLSSGTKDQSIMDVLKHKSFLEELLFWTIKYEFPQKMVTFLLNMLPDQEYKVAFTKTFVQHYAFIMKTLKKSHESDTMSNRIVHISVQLFSNEELARQVTEECQLLDIMVTVLLYMMESCLIKSELQDEENSLHVVVNCGEALLKNNTYWPLVSDFINILSHQSVAKRFLEDHGLLVTWMNFVSFFQGMNLNKRELNEHVEFESQTYYAAFAAELEACAQPMWGLLSHCKVRETQEYTRNVVRYCLEALQDWFDAINFVDEPAPNQVTFHLPLHRYYAMFLSKAVKCQELDLDSVLPDQEMLMKLMIHPLQIQASLAEIHSNMWVRNGLQIKGQAMTYVQSHFCNSMIDPDIYLLQVCASRLDPDYFISSVFERFKVVDLLTMASQHQNTVLDAEHERSMLEGALTFLVILLSLRLHLGMSDDEILRAEMVAQLCMNDRTHSSLLDLIPENPNPKSGIIPGSYSFESVLSAVADFKAPVFEPGGSMQQGMYTPKAEVWDQEFDPVMVILRTVYRRDVQSAMDRYTAFLKQSGKFPGNPWPPYKKRTSLHPSYKGLMRLLHCKTLHIVLFTLLYKILMDHQNLSEHVLCMVLYLIELGLENSAEEESDEEASVGGPERCHDSWFPGSNLVSNMRHFINYVRVRVPETAPEVKRDSPASTSSDNLGSLQNSGTAQVFSLVAERRKKFQEIINRSSSEANQVVRPKTSSKWSAPGSAPQLTTAILEIKESILSLLIKLHHKLSGKQNSYYPPWLDDIEILIQPEIPKYSHGDGITAVERILLKAASQSRMNKRIIEEICRKVTPPVPPKKVTAAEKKTLDKEERRQKARERQQKLLAEFASRQKSFMETAMDVDSPENDIPMEITTAEPQVSEAVYDCVICGQSGPSSEDRPTGLVVLLQASSVLGQCRDNVEPKKLPISEEEQIYPWDTCAAVHDVRLSLLQRYFKDSSCLLAVSIGWEGGVYVQTCGHTLHIDCHKSYMESLRNDQVLQGFSVDKGEFTCPLCRQFANSVLPCYPGSNVENNPWQRPSNKSIQDLIKEVEELQGRPGAFPSETNLSKEMESVMKDIKNTTQKKYRDYSKTPGSPDNDFLFMYSVARTNLELELIHRGGNLCSGGASTAGKRSCLNQLFHVLALHMRLYSIDSEYNPWRKLTQLEEMNPQLGYEEQQPEVPILYHDVTSLLLIQILMMPQPLRKDHFTCIVKVLFTLLYTQALAALSVKCSEEDRSAWKHAGALKKSTCDAEKSYEVLLSFVISELFKGKLYHEEGTQECAMVNPIAWSPESMEKCLQDFCLPFLRITSLLQHHLFGEDLPSCQEEEEFSVLASCLGLLPTFYQTEHPFISASCLDWPVPAFDIITQWCFEIKSFTERHAEQGKALLIQESKWKLPHLLQLPENYNTIFQYYHRKTCSVCTKVPKDPAVCLVCGTFVCLKGLCCKQQSYCECVLHSQNCGAGTGIFLLINASVIIIIRGHRFCLWGSVYLDAHGEEDRDLRRGKPLYICKERYKVLEQQWISHTFDHINKRWGPHYNGL

SEQ ID NO: 68944 - protein, 709 aa, Homo sapiens
MIASKQRQFTEVFRIMSSTFSQSRFLYAAVVTDSPENDIPMEITTAEPQVSEAVYDCVICGQSGPSSEDRPTGLVVLLQASSVLGQCRDNVEPKKLPISEEEQIYPWDTCAAVHDVRLSLLQRYFKDSSCLLAVSIGWEGGVYVQTCGHTLHIDCHKSYMESLRNDQVLQGFSVDKGEFTCPLCRQFANSVLPCYPGSNVENNPWQRPSNKSIQDLIKEVEELQGRPGAFPSETNLSKEMESVMKDIKNTTQKKYRDYSKTPGSPDNDFLFMYSVARTNLELELIHRGGNLCSGGASTAGKRSCLNQLFHVLALHMRLYSIDSEYNPWRKLTQLEEMNPQLGYEEQQPEVPILYHDVTSLLLIQILMMPQPLRKDHFTCIVKVLFTLLYTQALAALSVKCSEEDRSAWKHAGALKKSTCDAEKSYEVLLSFVISELFKGKLYHEEGTQECAMVNPIAWSPESMEKCLQDFCLPFLRITSLLQHHLFGEDLPSCQEEEEFSVLASCLGLLPTFYQTEHPFISASCLDWPVPAFDIITQWCFEIKSFTERHAEQGKALLIQESKWKLPHLLQLPENYNTIFQYYHRKTCSVCTKVPKDPAVCLVCGTFVCLKGLCCKQQSYCECVLHSQNCGAGTGIFLLINASVIIIIRGHRFCLWGSVYLDAHGEEDRDLRRGKPLYICKERYKVLEQQWISHTFDHINKRWGPHYNGL

SEQ ID NO: 68945 - protein, 1888 aa, Homo sapiens; identical to SEQ ID NO: 68943

SEQ ID NO: 68946 - protein, 1917 aa, Homo sapiens
MAAAAAAAVGGQQPSQPELPAPGLALDKAATAAHLKAALSRPDNRAGAEELQALLERVLSAERPLAAAAGGEDAAAAGGGGGPGAAEEEALEWCKCLLAGGGGYDEFCAAVRAYDPAALCGLVWTANFVAYRCRTCGISPCMSLCAECFHQGDHTGHDFNMFRSQAGGACDCGDSNVMRESGFCKRHQIKSSSNIPCVPKDLLMMSEFVLPRFIFCLIQYLREGYNEPAADGPSEKDLNKVLQLLEPQISFLEDLTKMGGAMRSVLTQVLTNQQNYKDLTSGLGENACVKKSHEKYLIALKSSGLTYPEDKLVYGVQEPSAGTSSLAVQGFIGATGTLGQVDSSDEDDQDGSQGLGKRKRVKLSSGTKDQSIMDVLKHKSFLEELLFWTIKYEFPQKMVTFLLNMLPDQEYKVAFTKTFVQHYAFIMKTLKKSHESDTMSNRIVHISVQLFSNEELARQVTEECQLLDIMVTVLLYMMESCLIKSELQDEENSLHVVVNCGEALLKNNTYWPLVSDFINILSHQSVAKRFLEDHGLLVTWMNFVSFFQGMNLNKRELNEHVEFESQTYYAAFAAELEACAQPMWGLLSHCKVRETQEYTRNVVRYCLEALQDWFDAINFVDEPAPNQVTFHLPLHRYYAMFLSKAVKCQELDLDSVLPDQEMLMKLMIHPLQIQASLAEIHSNMWVRNGLQIKGQAMTYVQSHFCNSMIDPDIYLLQVCASRLDPDYFISSVFERFKVVDLLTMASQHQNTVLDAEHERSMLEGALTFLVILLSLRLHLGMSDDEILRAEMVAQLCMNDRTHSSLLDLIPENPNPKSGIIPGSYSFESVLSAVADFKAPVFEPGGSMQQGMYTPKAEVWDQEFDPVMVILRTVYRRDVQSAMDRYTAFLKQSGKFPGNPWPPYKKRTSLHPSYKGLMRLLHCKTLHIVLFTLLYKILMDHQNLSEHVLCMVLYLIELGLENSAEEESDEEASVGGPERCHDSWFPGSNLVSNMRHFINYVRVRVPETAPEVKRDSPASTSSDNLGSLQNSGTAQVFSLVAERRKKFQEIINRSSSEANQVVRPKTSSKWSAPGSAPQLTTAILEIKESILSLLIKLHHKLSGKQNSYYPPWLDDIEILIQPEIPKYSHGDGITAVERILLKAASQSRMNKRIIEEICRKVTPPVPPKKVTAAEKKTLDKEERRQKARERQQKLLAEFASRQKSFMETAMDVDSPENDIPMEITTAEPQVSEAVYDCVICGQSGPSSEDRPTGLVVLLQASSVLGQCRDNVEPKKLPISEEEQIYPWDTCAAVHDVRLSLLQRYFKDSSCLLAVSIGWEGGVYVQTCGHTLHIDCHKSYMESLRNDQVLQGFSVDKGEFTCPLCRQFANSVLPCYPGSNVENNPWQRPSNKSIQDLIKEVEELQGRPGAFPSETNLSKEMESVMKDIKNTTQKKYRDYSKTPGSPDNDFLFMYSVARTNLELELIHRGGNLCSGGASTAGKRSCLNFCFIIFPFTKSEIILCQYRKSHDKVYPKYQLFHVLALHMRLYSIDSEYNPWRKLTQLEEMNPQLGYEEQQPEVPILYHDVTSLLLIQILMMPQPLRKDHFTCIVKVLFTLLYTQALAALSVKCSEEDRSAWKHAGALKKSTCDAEKSYEVLLSFVISELFKGKLYHEEGTQECAMVNPIAWSPESMEKCLQDFCLPFLRITSLLQHHLFGEDLPSCQEEEEFSVLASCLGLLPTFYQTEHPFISASCLDWPVPAFDIITQWCFEIKSFTERHAEQGKALLIQESKWKLPHLLQLPENYNTIFQYYHRKTCSVCTKVPKDPAVCLVCGTFVCLKGLCCKQQSYCECVLHSQNCGAGTGIFLLINASVIIIIRGHRFCLWGSVYLDAHGEEDRDLRRGKPLYICKERYKVLEQQWISHTFDHINKRWGPHYNGL

SEQ ID NO: 68947 - protein, 425 aa, Homo sapiens
MAGAEGAAGRQSELEPVVSLVDVLEEDEELENEACAVLGGSDSEKCSYSQGSVKRQALYACSTCTPEGEEPAGICLACSYECHGSHKLFELYTKRNFRCDCGNSKFKNLECKLLPDKAKVNSGNKYNDNFFGLYCICKRPYPDPEDEIPDEMIQCVVCEDWFHGRHLGAIPPESGDFQEMVCQACMKRCSFLWAYAAQLAVTKISTEDDGLVRNIDGIGDQEVIKPENGEHQDSTLKEDVPEQGKDDVREVKVEQNSEPCAGSSSESDLQTVFKNESLNAESKSGCKLQELKAKQLIKKDTATYWPLNWRSKLCTCQDCMKMYGDLDVLFLTDEYDTVLAYENKGKIAQATDRSDPLMDTLSSMNRVQQVELICEYNDLKTELKDYLKRFADEGTVVKREDIQQFFEEFQSKKRRRVDGMQYYCS

SEQ ID NO: 68948 - protein, 349 aa, Homo sapiens
MRRALSWAAATPRSAPTLRNFRCDCGNSKFKNLECKLLPDKAKVNSGNKYNDNFFGLYCICKRPYPDPEDEIPDEMIQCVVCEDWFHGRHLGAIPPESGDFQEMVCQACMKRCSFLWAYAAQLAVTKISTEDDGLVRNIDGIGDQEVIKPENGEHQDSTLKEDVPEQGKDDVREVKVEQNSEPCAGSSSESDLQTVFKNESLNAESKSGCKLQELKAKQLIKKDTATYWPLNWRSKLCTCQDCMKMYGDLDVLFLTDEYDTVLAYENKGKIAQATDRSDPLMDTLSSMNRVQQVELICEYNDLKTELKDYLKRFADEGTVVKREDIQQFFEEFQSKKRRRVDGMQYYCS

SEQ ID NO: 68949 - protein, 360 aa, Homo sapiens
MRRALSWAAATPRSAPTLRNFRCDCGNSKFKNLECKLLPDKAKVNSGNKYNDNFFGLYCICKRPYPDPEDEIPDEMIQCVVCEDWFHGRHLGAIPPESGDFQEMVCQACMKRCSFLWAYAAQLAVTKISTEDDGLVRNIDGIGDQEVIKPENGEHQDSTLKEDVPEQGKDDVREVKVEQNSEPCAGSSSESDLQTVFKNESLNAESKSGCKLQELKAKQLIKKDTATYWPLNWRSKLCTCQDCMKMYGDLDVLFLTDEYDTVLAYENKGKIAQATDRSDPLMDTLSSMNRVQQVELICEYNDLKTELKDYLKRFADEGTVVKREDIQQFFEEFQKKEKKSGWDAVLLQLEWSMKLSHSSQ

SEQ ID NO: 68950 - protein, 872 aa, Homo sapiens
MATACKRSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 68951 - protein, 872 aa, Homo sapiens
MRSVCHRSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 68952 - protein, 875 aa, Homo sapiens
MEKLHQCYWKSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 68953 - protein, 852 aa, Homo sapiens
MKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 68954 - protein, 852 aa, Homo sapiens; identical to SEQ ID NO: 68953

SEQ ID NO: 68955 - protein, 1083 aa, Homo sapiens
MFSFEGDFKTRPKVSLGGASRKEEKASLLHRTQEERRKREEERRRLKNAIIIQSFIRGYRDRKQQYSIQRSAFDRCATLSQSGGAFPIANGPNLTLLVRQLLFFYKQNEDSKRLIWLYQNLIKHSSLFVKQLDGSERLTCLFQIKRLMSLCCRLLQNCNDDSLNVALPMRMLEVFSSENTYLPVLQDASYVVSVIEQILHYMIHNGYYRSLYLLINSKLPSSIEYSDLSRVPIAKILLENVLKPLHFTYNSCPEGARQQVFTAFTEEFLAAPFTDQIFHFIIPALADAQTVFPYEPFLNALLLIESRCSRKSGGAPWLFYFVLTVGENYLGALSEEGLLVYLRVLQTFLSQLPVSPASASCHDSASDSEEESEEADKPSSPEDGRLSVSYITEECLKKLDTKQQTNTLLNLVWRDSASEEVFTTMASVCHTLMVQHRMMVPKVRLLYSLAFNARFLRHLWFLISSMSTRMITGSMVPLLQVISRGSPMSFEDSSRIIPLFYLFSSLFSHSLISIHDNEFFGDPIEVVGQRQSSMMPFTLEELIMLSRCLRDACLGIIKLAYPETKPEVREEYITAFQSIGVTTSSEMQQCIQMEQKRWIQLFKVITNLVKMLKSRDTRRNFCPPNHWLSEQEDIKADKVTQLYVPASRHVWRFRRMGRIGPLQSTLDVGLESPPLSVSEERQLAVLTELPFVVPFEERVKIFQRLIYADKQEVQGDGPFLDGINVTIRRNYIYEDAYDKLSPENEPDLKKRIRVHLLNAHGLDEAGIDGGGIFREFLNELLKSGFNPNQGFFKTTNEGLLYPNPAAQMLVGDSFARHYYFLGRMLGKALYENMLVELPFAGFFLSKLLGTSADVDIHHLASLDPEVYKNLLFLKSYEDDVEELGLNFTVVNNDLGEAQVVELKFGGKDIPVTSANRIAYIHLVADYRLNRQIRQHCLAFRQGLANVVSLEWLRMFDQQEIQVLISGAQVPISLEDLKSFTNYSGGYSADHPVIKVFWRVVEGFTDEEKRKLLKFVTSCSRPPLLGFKELYPAFCIHNGGSDLERLPTASTCMNLLKLPEFYDETLLRSKLLYAIECAAGFELS

SEQ ID NO: 68956 - protein, 404 aa, Homo sapiens
MFSFEGDFKTRPKVSLGGASRKYSIQRSAFDRCATLSQSGGAFPIANGPNLTLLVRQLLFFYKQNEDSKRLIWLYQNLIKHSSLFVKQLDGSERLTCLFQIKRLMSLCCRLLQNCNDDSLNVALPMRMLEVFSSENTYLPVLQDASYVVSVIEQILHYMIHNGYYRSLYLLINSKLPSSIEYSDLSRVPIAKILLENVLKPLHFTYNSCPEGARQQVFTAFTEEFLAAPFTDQIFHFIIPALADAQTVFPYEPFLNALLLIESRCSRKSGGAPWLFYFVLTVGENYLGALSEEGLLVYLRVLQTFLSQLPVSPASASCHDSASDSEEESEEADKPSSPEDGRLSVSYITEECLKKLDTKQQTNTLLNLVWRDSASEEVFTTMASVCHTLMVQHRMMVPKVRVYK

SEQ ID NO: 68957 - protein, 63 aa, Homo sapiens
MAAPLSVEVEFGSSPGCLFLWSSFAEVVRSSCLTVLRNIESLCLDRRNPGTSGTCSSGSRRIC

SEQ ID NO: 68958 - protein, 63 aa, Homo sapiens
MAAPLSVEVEFGGGAELLFDGIKKHRVTLPGQEEPWDIRNLLIWIKKNLLKERPELFIQGDSV

SEQ ID NO: 68959 - protein, 101 aa, Homo sapiens
MAAPLSVEVEFGGGAELLFDGIKKHRVTLPGQEEPWDIRNLLIWIKKNLLKERPELFIQGDSVRPGILVLINDADWELLGELDYQLQDQDSVLFISTLHGG

SEQ ID NO: 68960 - protein, 146 aa, Homo sapiens
MAAPLSVEVEFGGGAELLFDGIKKHRVTLPGQEEPWDIRNLLIWIKKNLLKERPELFIQGDSVRPGILVLINDADWELLVSTLGDIPPPAPALAASVGKRWASPQAHIEWLGNPPPHSSPTLRLLESPTPGEEGMGSWGHGSTPPS

SEQ ID NO: 68961 - protein, 785 aa, Homo sapiens
MPGVIPSESNGLSRGSPSKKNRLSLKFFQKKETKRALDFTDSQENEEKASEYRASEIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLRELNPMYEGYLQHDAQEVLQCILGNIQETCQLLKKEEVKNVAELPTKVEEIPHPKEEMNGINSIEMDSMRHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKENECDPEEDLGKCESDNTTNGCGLESPGNTVTPVNVNEVKPINKGEEQIGFELVEKLFQGQLVLRTRCLECESLTERREDFQDISVPVQEDELSKVEESSEISPEPKTEMKTLRWAISQFASVERIVGEDKYFCENCHHYTEAERSLLFDKMPEVITIHLKCFAASGLEFDCYGGGLSKINTPLLTPLKLSLEEWSTKPTNDSYGLFAVVMHSGITISSGHYTASVKVTDLNSLELDKGNFVVDQMCEIGKPEPLNEEEARGVVENYNDEEVSIRVGGNTQPSKVLNKKNVEAIGLLGGQKSKADYELYNKASNPDKVASTAFAENRNSETSDTTGTHESDRNKESSDQTGINISGFENKISYVVQSLKEYEGKWLLFDDSEVKVTEEKDFLNSLSPSTSPTSTPYLLFYKKL

SEQ ID NO: 68962 - protein, 785 aa, Homo sapiens; identical to SEQ ID NO: 68961

SEQ ID NO: 68963 - protein, 87 aa, Homo sapiens
MPGVIPSESNGLSRGSPSKKNRLSLKFFQKKETKRALDFTDSQENEEKASEYRASEIDQVVPAAQSSPINCEKRENLLPFVGLNNLG

SEQ ID NO: 68964 - protein, 186 aa, Homo sapiens
MPGVIPSESNGLSRGSPSKKNRLSLKFFQKKETKRALDFTDSQENEEKASEYRASEIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLR

SEQ ID NO: 68965 - protein, 798 aa, Homo sapiens
MALHSPQYIFGDFSPDEFNQFFVTPRSSVELPPYSGTVLCGTQAVDKLPDGQEYQRIEFGVDEVIEPSDTLPRTPSYSISSTLNPQAPEFILGCTASKITPDGITKEASYGSIDCQYPGSALALDGSSNVEAEVLENDGVSGGLGQRERKKKKKRPPGYYSYLKDGGDDSISTEALVNGHANSAVPNSVSAEDAEFMGDMPPSVTPRTCNSPQNSTDSVSDIVPDSPFPGALGSDTRTAGQPEGGPGADFGQSCFPAEAGRDTLSRTAGAQPCVGTDTTENLGVANGQILESSGEGTATNGVELHTTESIDLDPTKPESASPPADGTGSASGTLPVSQPKSWASLFHDSKPSSSSPVAYVETKYSPPAISPLVSEKQVEVKEGLVPVSEDPVAIKIAELLENVTLIHKPVSLQPRGLINKGNWCYINATLQALVACPPMYHLMKFIPLYSKVQRPCTSTPMIDSFVRLMNEFTNMPVPPKPRQALGDKIVRDIRPGAAFEPTYIYRLLTVNKSSLSEKGRQEDAEEYLGFILNGLHEEMLNLKKLLSPSNEKLTISNGPKNHSVNEEEQEEQGEGSEDEWEQVGPRNKTSVTRQADFVQTPITGIFGGHIRSVVYQQSSKESATLQPFFTLQLDIQSDKIRTVQDALESLVARESVQGYTTKTKQEVEISRRVTLEKLPPVLVLHLKRFVYEKTGGCQKLIKNIEYPVDLEISKELLSPGVKNKNFKCHRTYRLFAVVYHHGNSATGGHYTTDVFQIGLNGWLRIDDQTVKVINQYQVVKPTAERTAYLLYYRRVDLL

SEQ ID NO: 68966 - protein, 228 aa, Homo sapiens
MYHLMKFIPLYSKVQRPCTSTPMIDSFVRLMNEFTNMPVPPKPRQALGDKIVRDIRPGAAFEPTYIYRLLTVNKSSLSEKGRQEDAEEYLGFILNGLHEEMLNLKKLLSPSNEKLTISNGPKNHSVNEEEQEEQGEGSEDEWEQVGPRNKTSVTRQADFVQTPITGFWWTHQVCGLPAEFKRICHFAAIFHVAVGYPVRQDTHSPGCTGELGGKRICPRLYHKNQTRG

SEQ ID NO: 68967 - protein, 62 aa, Homo sapiens
MALHSPQYIFGDFSPDEFNQFFVTPRSSVEDKNIRELSLVSMKSLNPVTLCREPPATVFQAH

SEQ ID NO: 68968 - protein, 963 aa, Homo sapiens
MAVAPRLFGGLCFRFRDQNPEVAVEGRLPISHSCVGCRRERTAMATVAANPAAAAAAVAAAAAVTEDREPQHEELPGLDSQWRQIENGESGRERPLRAGESWFLVEKHWYKQWEAYVQGGDQDSSTFPGCINNATLFQDEINWRLKEGLVEGEDYVLLPAAAWHYLVSWYGLEHGQPPIERKVIELPNIQKVEVYPVELLLVRHNDLGKSHTVQFSHTDSIGLVLRTARERFLVEPQEDTRLWAKNSEGSLDRLYDTHITVLDAALETGQLIIMETRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 68969 - protein, 920 aa, Homo sapiens
MATVAANPAAAAAAVAAAAAVTEDREPQHEELPGLDSQWRQIENGESGRERPLRAGESWFLVEKHWYKQWEAYVQGGDQDSSTFPGCINNATLFQDEINWRLKEGLVEGEDYVLLPAAAWHYLVSWYGLEHGQPPIERKVIELPNIQKVEVYPVELLLVRHNDLGKSHTVQFSHTDSIGLVLRTARERFLVEPQEDTRLWAKNSEGSLDRLYDTHITVLDAALETGQLIIMETRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 68970 - protein, 370 aa, Homo sapiens
MEILMTVSKFASICTMGANASALEKEIGPEQFPVNEHYFGLVNFGNTCYCNSVLQALYFCRPFREKVLAYKSQPRKKESLLTCLADLFHSIATQKKKVGVIPPKKFITRLRKENELFDNYMQQDAHEFLNYLLNTIADILQEERKQEKQNGRLPNGNIDNENNNSTPDPTWVHEIFQGTLTNETRCLTCETISSKDEDFLDLSVDVEQNTSITHCLRGFSNTETLCSEYKYYCEECRSKQEAHKRMKVKKLPMILALHLKRFKYMDQLHRYTKLSYRVVFPLELRLFNTSGDATNPDRMYDLVAVVVHCGSGPNRGHYIAIVKSHDFWLLFDDDIVEKIDAQAIEEFYGLTSDISKNSESGYILFYQSRD

SEQ ID NO: 68971 - protein, 863 aa, Homo sapiens
MQRRGALFGMPGGSGGRKMAAGDIGELLVPHMPTIRVPRSGDRVYKNECAFSYDSPNSEGGLYVCMNTFLAFGREHVERHFRKTGQSVYMHLKRHVREKVRGASGGALPKRRNSKIFLDLDTDDDLNSDDYEYEDEAKLVIFPDHYEIALPNIEELPALVTIACDAVLSSKSPYRKQDPDTWENELPVSKYANNLTQLDNGVRIPPSGWKCARCDLRENLWLNLTDGSVLCGKWFFDSSGGNGHALEHYRDMGYPLAVKLGTITPDGADVYSFQEEEPVLDPHLAKHLAHFGIDMLHMHGTENGLQDNDIKLRVSEWEVIQESGTKLKPMYGPGYTGLKNLGNSCYLSSVMQAIFSIPEFQRAYVGNLPRIFDYSPLDPTQDFNTQMTKLGHGLLSGQYSKPPVKSELIEQVMKEEHKPQQNGISPRMFKAFVSKSHPEFSSNRQQDAQEFFLHLVNLVERNRIGSENPSDVFRFLVEERIQCCQTRKVRYTERVDYLMQLPVAMEAATNKDELIAYELTRREAEANRRPLPELVRAKIPFSACLQAFSEPENVDDFWSSALQAKSAGVKTSRFASFPEYLVVQIKKFTFGLDWVPKKFDVSIDMPDLLDINHLRARGLQPGEEELPDISPPIVIPDDSKDRLMNQLIDPSDIDESSVMQLAEMGFPLEACRKAVYFTGNMGAEVAFNWIIVHMEEPDFAEPLTMPGYGGAASAGASVFGASGLDNQPPEEIVAIITSMGFQRNQAIQALRATNNNLERALDWIFSHPEFEEDSDFVIEMENNANANIISEAKPEGPRVKDGSGTYELFAFISHMGTSTMSGHYICHIKKEGRWVIYNDHKVCASERPPKDLGYMYFYRRIPS

SEQ ID NO: 68972 - protein, 494 aa, Homo sapiens
MPLYSVTVKWGKEKFEGVELNTDEPPMVFKAQLFALTGVQPARQKVMVKGGTLKDDDWGNIKIKNGMTLLMMGSADALPEEPSAKTVFVEDMTEEQLASAMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 68973 - protein, 459 aa, Homo sapiens
MPLYSVTVKWGKEKFEGVELNTDEPPMVFKAQLFALTGVQPARQKVMVKGGTLKDDDWGNIKIKNMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 68974 - protein, 483 aa, Homo sapiens
MPLYSVTVKWGKEKFEGVELNTDEPPMVFKAQLFALTGVQPARQKVMVKGGTLKGMTLLMMGSADALPEEPSAKTVFVEDMTEEQLASAMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 68975 - protein, 459 aa, Homo sapiens; identical to SEQ ID NO: 68973

SEQ ID NO: 68976 - protein, 372 aa, Homo sapiens
MSKAFGLLRQICQSILAESSQSPADLEEKKEEDSNMKREQPRERPRAWDYPHGLVGLHNIGQTCCLNSLIQVFVMNVDFTRILKRITVPRGADEQRRSVPFQMLLLLEKMQDSRQKAVRPLELAYCLQKCNVPLFVQHDAAQLYLKLWNLIKDQITDVHLVERLQALYTIRVKDSLICVDCAMESSRNSSMLTLPLSLFDVDSKPLKTLEDALHCFFQPRELSSKSKCFCENCGKKTRGKQVLKLTHLPQTLTIHLMRFSIRNSQTRKICHSLYFPQSLDFSQILPMKRESCDAEEQSGGQYELFAVIAHVGMADSGHYCVYIRNAVDGKWFCFNDSNICLVSWEDIQCTYGNPNYHWQETAYLLVYMKMEC

SEQ ID NO: 68977 - protein, 243 aa, Homo sapiens
TIRVKDSLICVDCAMESSRNSSMLTLPLSLFDVDSKPLKTLEDALHCFFQPRELSSKSKCFCENCGKKTRGKQVLKLTHLPQTLTIHLMRFSIRNSQTRKICHSLYFPQSLDFSQILPMKRESCDAEEQSGGQYELFAVIAHVGMADSGHYCVYIRNAVDGKWFCFNDSNICLVSWEDIQCTYGNPNYHWPPFLCHACILIEDGEYLRLFRPANIRQFTSREETWVECWCVLTLQCKQLQQVW

SEQ ID NO: 68978 - protein, 565 aa, Homo sapiens
MPQASEHRLGRTREPPVNIQPRVGSKLPFAPRARSKERRNPASGPNPMLRPLPPRPGLPDERLKKLELGRGRTSGPRPRGPLRADHGVPLPGSPPPTVALPLPSRTNLARSKSVSSGDLRPMGIALGGHRGTGELGAALSRLALRPEPPTLRRSTSLRRLGGFPGPPTLFSIRTEPPASHGSFHMISARSSEPFYSDDKMAHHTLLLGSGHVGLRNLGNTCFLNAVLQCLSSTRPLRDFCLRRDFRQEVPGGGRAQELTEAFADVIGALWHPDSCEAVNPTRFRAVFQKYVPSFSGYSQQDAQEFLKLLMERLHLEINRRGRRAPPILANGPVPSPPRRGGALLEEPELSDDDRANLMWKRYLEREDSKIVDLFVGQLKSCLKCQACGYRSTTFEVFCDLSLPIPKKGFAGGKVSLRDCFNLFTKEEELESENAPVCDRCRQKTRSTKKLTVQRFPRILVLHLNRFSASRGSIKKSSVGVDFPLQRLSLGDFASDKAGSPVYQLYALCNHSGSVHYGHYTALCRCQTGWHVYNDSRVSPVSENQVASSEGYVLFYQLMQEPPRCL

SEQ ID NO: 68979 - protein, 551 aa, Homo sapiens
MPQASEHRLGRTREPPVNIQPRVGSKLPFAPRARSKERRNPASGPNPMLRPLPPRPGLPDERLKKLELGRGRTSGPRPRGPLRADHGVPLPGSPPPTVALPLPSRTNLARSKSVSSGDLRPMGIALGGHRGTGELGAALSRLALRPEPPTLRRSTSLRRLGGFPGPPTLFSIRTEPPASHGSFHMISARSSEPFYSDDKMAHHTLLLGSGHVGLRNLGNTCFLNAVLQCLSSTRPLRDFCLRRDFRQEVPGGGRAQELTEAFADVIGALWHPDSCEAVNPTRFRAVFQKYVPSFSGYSQQDAQEFLKLLMERLHLEINRRGRRAPPILANGPVPSPPRRGGALLEEPELSDDDRANLMWKRYLEREDSKIVDLFVGQLKSCLKCQACGYRSTTFEVFCDLSLPIPKKGFAGGKVSLRDCFNLFTKEEELESENAPVCDRCRQKTRSTKKLTVQRFPRILVLHLNRFSASRGSIKKSSVGVDFPLQRLSLGDFASDKAGSVHYGHYTALCRCQTGWHVYNDSRVSPVSENQVASSEGYVLFYQLMQEPPRCL

SEQ ID NO: 68980 - protein, 565 aa, Homo sapiens; identical to SEQ ID NO: 68978

SEQ ID NO: 68981 - protein, 525 aa, Homo sapiens
MVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 68982 - protein, 593 aa, Homo sapiens
AAAARGRCLPCSLPSAIAQPHLCPASALCSRRPGLGQPGQPPSSPHAALASSSPPSPPPPARGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 68983 - protein, 513 aa, Homo sapiens
MAPGWPSLSAGSRQEAPQLAAGGSAYQAVGRQFQPRATALQGPSQAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 68984 - protein, 2620 aa, Homo sapiens
MESEEEQHMTTLLCMGFSDPATIRKALRLAKNDINEAVALLTNERPGLDYGGYEPMDSGGGPSPGPGGGPRGDGGGDGGGGGPSRGGSTGGGGGFDPPPAYHEVVDAEKNDENGNCSGEGIEFPTTNLYELESRVLTDHWSIPYKREESLGKCLLASTYLARLGLSESDENCRRFMDRCMPEAFKKLLTSSAVHKWGTEIHEGIYNMLMLLIELVAERIKQDPIPTGLLGVLTMAFNPDNEYHFKNRMKVSQRNWAEVFGEGNMFAVSPVSTFQKEPHGWVVDLVNKFGELGGFAAIQAKLHSEDIELGAVSALIQPLGVCAEYLNSSVVQPMLDPVILTTIQDVRSVEEKDLKDKRLVSIPELLSAVKLLCMRFQPDLVTIVDDLRLDILLRMLKSPHFSAKMNSLKEVTKLIEDSTLSKSVKNAIDTDRLLDWLVENSVLSIALEGNIDQAQYCDRIKGIIELLGSKLSLDELTKIWKIQSGQSSTVIENIHTIIAAAAVKFNSDQLNHLFVLIQKSWETESDRVRQKLLSLIGRIGREARFETTSGKVLDVLWELAHLPTLPSSLIQQALEEHLTILSDAYAVKEAIKRSYIIKCIEDIKRPGEWSGLEKNKKDGFKSSQLNNPQFVWVVPALRQLHEITRSFIKQTYQKQDKSIIQDLKKNFEIVKLVTGSLIACHRLAAAVAGPGGLSGSTLVDGRYTYREYLEAHLKFLAFFLQEATLYLGWNRAKEIWECLVTGQDVCELDREMCFEWFTKGQHDLESDVQQQLFKEKILKLESYEITMNGFNLFKTFFENVNLCDHRLKRQGAQLYVEKLELIGMDFIWKIAMESPDEEIANEAIQLIINYSYINLNPRLKKDSVSLHKKFIADCYTRLEAASSALGGPTLTHAVTRATKMLTATAMPTVATSVQSPYRSTKLVIIERLLLLAERYVITIEDFYSVPRTILPHGASFHGHLLTLNVTYESTKDTFTVEAHSNETIGSVRWKIAKQLCSPVDNIQIFTNDSLLTVNKDQKLLHQLGFSDEQILTVKTSGSGTPSGSSADSSTSSSSSSSGVFSSSYAMEQEKSLPGVVMALVCNVFDMLYQLANLEEPRITLRVRKLLLLIPTDPAIQEALDQLDSLGRKKTLLSESSSQSSKSPSLSSKQQHQPSASSILESLFRSFAPGMSTFRVLYNLEVLSSKLMPTADDDMARSCAKSFCENFLKAGGLSLVVNVMQRDSIPSEVDYETRQGVYSICLQLARFLLVGQTMPTLLDEDLTKDGIEALSSRPFRNVSRQTSRQMSLCGTPEKSSYRQLSVSDRSSIRVEEIIPAARVAIQTMEVSDFTSTVACFMRLSWAAAAGRLDLVGSSQPIKESNSLCPAGIRNRLSSSGSNCSSGSEGEPVALHAGICVRQQSVSTKDSLIAGEALSLLVTCLQLRSQQLASFYNLPCVADFIIDILLGSPSAEIRRVACDQLYTLSQTDTSAHPDVQKPNQFLLGVILTAQLPLWSPTSIMRGVNQRLLSQCMEYFDLRCQLLDDLTTSEMEQLRISPATMLEDEITWLDNFEPNRTAECETSEADNILLAGHLRLIKTLLSLCGAEKEMLGSSLIKPLLDDFLFRASRIILNSHSPAGSAAISQQDFHPKCSTANSRLAAYEVLVMLADSSPSNLQIIIKELLSMHHQPDPALTKEFDYLPPVDSRSSSGFVGLRNGGATCYMNAVFQQLYMQPGLPESLLSVDDDTDNPDDSVFYQVQSLFGHLMESKLQYYVPENFWKIFKMWNKELYVREQQDAYEFFTSLIDQMDEYLKKMGRDQIFKNTFQGIYSDQKICKDCPHRYEREEAFMALNLGVTSCQSLEISLDQFVRGEVLEGSNAYYCEKCKEKRITVKRTCIKSLPSVLVIHLMRFGFDWESGRSIKYDEQIRFPWMLNMEPYTVSGMARQDSSSEVGENGRSVDQGGGGSPRKKVALTENYELVGVIVHSGQAHAGHYYSFIKDRRGCGKGKWYKFNDTVIEEFDLNDETLEYECFGGEYRPKVYDQTNPYTDVRRRYWNAYMLFYQRVSDQNSPVLPKKSRVSVVRQEAEDLSLSAPSSPEISPQSSPRPHRPNNDRLSILTKLVKKGEKKGLFVEKMPARIYQMVRDENLKFMKNRDVYSSDYFSFVLSLASLNATKLKHPYYPCMAKVSLQLAIQFLFQTYLRTKKKLRVDTEEWIATIEALLSKSFDACQWLVEYFISSEGRELIKIFLLECNVREVRVAVATILEKTLDSALFYQDKLKSLHQLLEVLLALLDKDVPENCKNCAQYFFLFNTFVQKQGIRAGDLLLRHSALRHMISFLLGASRQNNQIRRWSSAQAREFGNLHNTVALLVLHSDVSSQRNVAPGIFKQRPPISIAPSSPLLPLHEEVEALLFMSEGKPYLLEVMFALRELTGSLLALIEMVVYCCFCNEHFSFTMLHFIKNQLETAPPHELKNTFQLLHEILVIEDPIQVERVKFVFETENGLLALMHHSNHVDSSRCYQCVKFLVTLAQKCPAAKEYFKENSHHWSWAVQWLQKKMSEHYWTPQSNVSNETSTGKTFQRTISAQDTLAYATALLNEKEQSGSSNGSESSPANENGDRHLQQGSESPMMIGELRSDLDDVDP

SEQ ID NO: 68985 - protein, 2460 aa, Homo sapiens
MTTLLCMGFSDPATIRKALRLAKNDINEAVALLTNERPGLDYGGYEPMDSGGLSESDENCRRFMDRCMPEAFKKLLTSSAVHKWGTEIHEGIYNMLMLLIELVAERIKQDPIPTGLLGVLTMAFNPDNEYHFKNRMKVSQRNWAEVFGEGNMFAVSPVSTFQKEPHGWVVDLVNKFGELGGFAAIQAKLHSEDIELGAVSALIQPLGVCAEYLNSSVVQPMLDPVILTTIQDVRSVEEKDLKDKRLVSIPELLSAVKLLCMRFQPDLVTIVDDLRLDILLRMLKSPHFSAKMNSLKEVTKLIEDSTLSKSVKNAIDTDRLLDWLVENSVLSIALEGNIDQAQYCDRIKGIIELLGSKLSLDELTKIWKIQSGQSSTVIENIHTIIAAAAVKFNSDQLNHLFVLIQKVLDVLWELAHLPTLPSSLIQQALEEHLTILSDAYAVKEAIKRSYIIKCIEDIKRSSQLNNPQFVWVVPALRQLHEITRSFIKQTYQKQDKSIIQDLKKNFEIVKLVTGSLIACHRLAAAVAGPGGLSGSTLVDGRYTYREYLEAHLKFLAFFLQEATLYLGWNRAKEIWECLVTGQDVCELDREMCFEWFTKGQHDLESDVQQQLFKEKILKLESYEITMNGFNLFKTFFENVNLCDHRLKRQGAQLYVEKLELIGMDFIWKIAMESPDEEIANEAIQLIINYSYINLNPRLKKDSVSLHKKFIADCYTRLEAASSALGGPTLTHAVTRATKMLTATAMPTVATSVQSPYRSTKLVIIERLLLLAERYVITIEDFYSVPRTILPHGASFHGHLLTLNVTYESTKDTFTVEAHSNETIGSVRWKIAKQLCSPVDNIQIFTNDSLLTVNKDQKLLHQLGFSDEQILTVKTSGSGTPSGSSADSSTSSSSSSSGVFSSSYAMEQEKSLPGVVMALVCNVFDMLYQLANLEEPRITLRVRKLLLLIPTDPAIQEALDQLDSLGRKKTLLSESSSQSSKSPSLSSKQQHQPSASSILESLFRSFAPGMSTFRVLYNLEVLSSKLMPTADDDMARSCAKSFCENFLKAGGLSLVVNVMQRDSIPSEVDYETRQGVYSICLQLARFLLVGQTMPTLLDEDLTKDGIEALSSRPFRNVSRQTSRQMSLCGTPEKSSYRQLSVSDRSSIRVEEIIPAARVAIQTMEVSDFTSTVACFMRLSWAAAAGRLDLVGSSQPIKESNSLCPAGIRNRLSSSGSNCSSGSEGEPVALHAGICVRQQSVSTKDSLIAGEALSLLVTCLQLRSQQLASFYNLPCVADFIIDILLGSPSAEIRRVACDQLYTLSQTDTSAHPDVQKPNQFLLGVILTAQLPLWSPTSIMRGVNQRLLSQCMEYFDLRCQLLDDLTTSEMEQLRISPATMLEDEITWLDNFEPNRTAECETSEADNILLAGHLRLIKTLLSLCGAEKEMLGSSLIKPLLDDFLFRASRIILNSHSPAGSAAISQQDFHPKCSTANSRLAAYEVLVMLADSSPSNLQIIIKELLSMHHQPDPALTKEFDYLPPVDSRSSSGFVGLRNGGATCYMNAVFQQLYMQPGLPESLLSVDDDTDNPDDSVFYQVQSLFGHLMESKLQYYVPENFWKIFKMWNKELYVREQQDAYEFFTSLIDQMDEYLKKMGRDQIFKNTFQGIYSDQKICKDCPHRYEREEAFMALNLGVTSCQSLEISLDQFVRGEVLEGSNAYYCEKCKEKRITVKRTCIKSLPSVLVIHLMRFGFDWESGRSIKYDEQIRFPWMLNMEPYTVSGMARQDSSSEVGENGRSVDQGGGGSPRKKVALTENYELVGVIVHSGQAHAGHYYSFIKDRRGCGKGKWYKFNDTVIEEFDLNDETLEYECFGGEYRPKVYDQTNPYTDVRRRYWNAYMLFYQRVSDQNSPVLPKKSRVSVVRQEAEDLSLSAPSSPEISPQSSPRPHRPNNDRLSILTKLVKKGEKKGLFVEKMPARIYQMVRDENLKFMKNRDVYSSDYFSFVLSLASLNATKLKHPYYPCMAKVSLQLAIQFLFQTYLRTKKKLRVDTEEWIATIEALLSKSFDACQWLVEYFISSEGRELIKIFLLECNVREVRVAVATILEKTLDSALFYQDKLKSLHQLLEVLLALLDKDVPENCKNCAQYFFLFNTFVQKQGIRAGDLLLRHSALRHMISFLLGASRQNNQIRRWSSAQAREFGNLHNTVALLVLHSDVSSQRNVAPGIFKQRPPISIAPSSPLLPLHEEVEALLFMSEGKPYLLEVMFALRELTGSLLALIEMVVYCCFCNEHFSFTMLHFIKNQLETAPPHELKNTFQLLHEILVIEDPIQVERVKFVFETENGLLALMHHSNHVDSSRCYQCVKFLVTLAQKCPAAKEYFKENSHHWSWAVQWLQKKMSEHYWTPQSNVSNETSTGKTFQRTISAQDTLAYATALLNEKEQSGSSNGSESSPANENGDRHLQQGSESPMMIGELRSDLDDVDP

SEQ ID NO: 68986 - protein, 913 aa, Homo sapiens
MAALFLRGFVQIGNCKTGISKSKEAFIEAVERKKKDRLVLYFKSGKYSTFRLSDNIQNVVLKSYRGNQNHLHLTLQNNNGLFIEGLSSTDAEQLKIFLDRVHQNEVQPPVRPGKGGSVFSSTTQKEINKTSFHKVDEKSSSKSFEIAKGSGTGVLQRMPLLTSKLTLTCGELSENQHKKRKRMLSSSSEMNEEFLKENNSVEYKKSKADCSRCVSYNREKQLKLKELEENKKLECESSCIMNATGNPYLDDIGLLQALTEKMVLVFLLQQGYSDGYTKWDKLKLFFELFPEKICHGLPNLGNTCYMNAVLQSLLSIPSFADDLLNQSFPWGKIPLNALTMCLARLLFFKDTYNIEIKEMLLLNLKKAISAAAEIFHGNAQNDAHEFLAHCLDQLKDNMEKLNTIWKPKSEFGEDNFPKQVFADDPDTSGFSCPVITNFELELLHSIACKACGQVILKTELNNYLSINLPQRIKAHPSSIQSTFDLFFGAEELEYKCAKCEHKTSVGVHSFSRLPRILIVHLKRYSLNEFCALKKNDQEVIISKYLKVSSHCNEGTRPPLPLSEDGEITDFQLLKVIRKMTSGNISVSWPATKESKDILAPHIGSDKESEQKKGQTVFKGASRRQQQKYLGKNSKPNELESVYSGDRAFIEKEPLAHLMTYLEDTSLCQFHKAGGKPASSPGTPLSKVDFQTVPENPKRKKYVKTSKFVAFDRIINPTKDLYEDKNIRIPERFQKVSEQTQQCDGMRICEQAPQQALPQSFPKPGTQGHTKNLLRPTKLNLQKSNRNSLLALGSNKNPRNKDILDKIKSKAKETKRNDDKGDHTYRLISVVSHLGKTLKSGHYICDAYDFEKQIWFTYDDMRVLGIQEAQMQEDRRCTGYIFFYMHNEIFEEMLKREENAQLNSKEVEETLQKE

SEQ ID NO: 68987 - protein, 913 aa, Homo sapiens; identical to SEQ ID NO: 68986

SEQ ID NO: 68988 - protein, 1077 aa, Homo sapiens
MTAELQQDDAAGAADGHGSSCQMLLNQLREITGIQDPSFLHEALKASNGDITQAVSLLTDERVKEPSQDTVATEPSEVEGSAANKEVLAKVIDLTHDNKDDLQAAIALSLLESPKIQADGRDLNRMHEATSAETKRSKRKRCEVWGENPNPNDWRRVDGWPVGLKNVGNTCWFSAVIQSLFQLPEFRRLVLSYSLPQNVLENCRSHTEKRNIMFMQELQYLFALMMGSNRKFVDPSAALDLLKGAFRSSEEQQQDVSEFTHKLLDWLEDAFQLAVNVNSPRNKSENPMVQLFYGTFLTEGVREGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLERYVKYGSGPARFPLPDMLKYVIEFASTKPASESCPPESDTHMTLPLSSVHCSVSDQTSKESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVPYRLHAVLVHEGQANAGHYWAYIYNQPRQSWLKYNDISVTESSWEEVERDSYGGLRNVSAYCLMYINDKLPYFNAEAAPTESDQMSEVEALSVELKHYIQEDNWRFEQEVEEWEEEQSCKIPQMESSTNSSSQDYSTSQEPSVASSHGVRCLSSEHAVIVKEQTAQAIANTARAYEKSGVEAALSEVMLSPAMQGVILAIAKARQTFDRDGSEAGLIKAFHEEYSRLYQLAKETPTSHSDPRLQHVLVYFFQNEAPKRVVERTLLEQFADKNLSYDERSISIMKVAQAKLKEIGPDDMNMEEYKKWHEDYSLFRKVSVYLLTGLELYQKGKYQEALSYLVYAYQSNAALLMKGPRRGVKESVIALYRRKCLLELNAKAASLFETNDDHSVTEGINVMNELIIPCIHLIINNDISKDDLDAIEVMRNHWCSYLGQDIAENLQLCLGEFLPRLLDPSAEIIVLKEPPTIRPNSPYDLCSRFAAVMESIQGVSTVTVK

SEQ ID NO: 68989 - protein, 1045 aa, Homo sapiens
MTAELQQDDAAGAADGHGSSCQMLLNQLREITGIQDPSFLHEALKASNGDITQAVSLLTDERVKEPSQDTVATEPSEVEGSAANKEVLAKVIDLTHDNKDDLQAAIALSLLESPKIQADGRDLNRMHEATSAETKRSKRKRCEVWGENPNPNDWRRVDGWPVGLKNVGNTCWFSAVIQSLFQLPEFRRLVLSYSLPQNVLENCRSHTEKRNIMFMQELQYLFALMMGSNRKFVDPSAALDLLKGAFRSSEEQQQDVSEFTHKLLDWLEDAFQLAVNVNSPRNKSENPMVQLFYGTFLTEGVREGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLERYVKYGSGPARFPLPDMLKYVIEFASTKPASESCPPESDTHMTLPLSSVHCSVSDQTSKESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVPYRLHAVLVHEGQANAGHYWAYIYNQPRQSWLKYNDISVTESSWEEVERDSYGGLRNVSAYCLMYINDKLPYFNAEAAPTESDQMSEVEALSVELKHYIQEDNWRFEQEVEEWEEEQSCKIPQMESSTNSSSQDYSTSQEPSVASSHGVRCLSSEHAVIVKEQTAQAIANTARAYEKSGVEAALSEAFHEEYSRLYQLAKETPTSHSDPRLQHVLVYFFQNEAPKRVVERTLLEQFADKNLSYDERSISIMKVAQAKLKEIGPDDMNMEEYKKWHEDYSLFRKVSVYLLTGLELYQKGKYQEALSYLVYAYQSNAALLMKGPRRGVKESVIALYRRKCLLELNAKAASLFETNDDHSVTEGINVMNELIIPCIHLIINNDISKDDLDAIEVMRNHWCSYLGQDIAENLQLCLGEFLPRLLDPSAEIIVLKEPPTIRPNSPYDLCSRFAAVMESIQGVSTVTVK

SEQ ID NO: 68990 - protein, 498 aa, Homo sapiens
MQSPPHLAVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 68991 - protein, 520 aa, Homo sapiens
MECPHLSSSVCIAPDSAKFPNGSPSSWCCSVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 68992 - protein, 156 aa, Homo sapiens [sequence omitted]

SEQ ID NO: 68993 - protein, 356 aa, Homo sapiens [sequence omitted]

SEQ ID NO: 68994 - protein, 271 aa, Homo sapiens
MPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 68995 - protein, 476 aa, Homo sapiens
MECPHLSSSVCIAPDSAKFPNGSPSSWCCSVCRSNKSPWVCLTCSSVHCGSYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 68996 - protein, 55 aa, Homo sapiens
MECPHLSSSVCIAPDSAKFPNGSPSSWCCSVCRSNKSPWVCLTCSSVHCGRIWGT

SEQ ID NO: 68997 - protein, 517 aa, Homo sapiens
MLSSRAEAAMTAADRAIQRFLRTGAAVRYKVMKNWGVIGGIAAALAAGIYVIWGPITERKKRRKGLVPGLVNLGNTCFMNSLLQGLSACPAFIRWLEEFTSQYSRDQKEPPSHQYLSLTLLHLLKALSCQEVTDDEVLDASCLLDVLRMYRWQISSFEEQDAHELFHVITSSLEDERDRQPRVTHLFDVHSLEQQSEITPKQITCRTRGSPHPTSNHWKSQHPFHGRLTSNMVCKHCEHQSPVRFDTFDSLSLSIPAATWGHPLTLDHCLHHFISSESVRDVVCDNCTKIEAKGTLNGEKVEHQRTTFVKQLKLGKLPQCLCIHLQRLSWSSHGTPLKRHEHVQFNEFLMMDIYKYHLLGHKPSQHNPKLNKNPGPTLELQDGPGAPTPVLNQPGAPKTQIFMNGACSPSLLPTLSAPMPFPLPVVPDYSSSTYLFRLMAVVVHHGDMHSGHFVTYRRSPPSARNPLSTSNQWLWVSDDTVRKASLQEVLSSSAYLLFYERVLSRMQHQSQECKSEE

SEQ ID NO: 68998 - protein, 1604 aa, Homo sapiens
MGAKESRIGFLSYEEALRRVTDVELKRLKDAFKRTCGLSYYMGQHCFIREVLGDGVPPKVAEVIYCSFGGTSKGLHFNNLIVGLVLLTRGKDEEKAKYIFSLFSSESGNYVIREEMERMLHVVDGKVPDTLRKCFSEGEKVNYEKFRNWLFLNKDAFTFSRWLLSGGVYVTLTDDSDTPTFYQTLAGVTHLEESDIIDLEKRYWLLKAQSRTGRFDLETFGPLVSPPIRPSLSEGLFNAFDENRDNHIDFKEISCGLSACCRGPLAERQKFCFKVFDVDRDGVLSRVELRDMVVALLEVWKDNRTDDIPELHMDLSDIVEGILNAHDTTKMGHLTLEDYQIWSVKNVLANEFLNLLFQVCHIVLGLRPATPEEEGQIIRGWLERESRYGLQAGHNWFIISMQWWQQWKEYVKYDANPVVIEPSSVLNGGKYSFGTAAHPMEQVEDRIGSSLSYVNTTEEKFSDNISTASEASETAGSGFLYSATPGADVCFARQHNTSDNNNQCLLGANGNILLHLNPQKPGAIDNQPLVTQEPVKATSLTLEGGRLKRTPQLIHGRDYEMVPEPVWRALYHWYGANLALPRPVIKNSKTDIPELELFPRYLLFLRQQPATRTQQSNIWVNMGNVPSPNAPLKRVLAYTGCFSRMQTIKEIHEYLSQRLRIKEEDMRLWLYNSENYLTLLDDEDHKLEYLKIQDEQHLVIEVRNKDMSWPEEMSFIANSSKIDRHKVPTEKGATGLSNLGNTCFMNSSIQCVSNTQPLTQYFISGRHLYELNRTNPIGMKGHMAKCYGDLVQELWSGTQKNVAPLKLRWTIAKYAPRFNGFQQQDSQELLAFLLDGLHEDLNRVHEKPYVELKDSDGRPDWEVAAEAWDNHLRRNRSIVVDLFHGQLRSQVKCKTCGHISVRFDPFNFLSLPLPMDSYMHLEITVIKLDGTTPVRYGLRLNMDEKYTGLKKQLSDLCGLNSEQILLAEVHGSNIKNFPQDNQKVRLSVSGFLCAFEIPVPVSPISASSPTQTDFSSSPSTNEMFTLTTNGDLPRPIFIPNGMPNTVVPCGTEKNFTNGMVNGHMPSLPDSPFTGYIIAVHRKMMRTELYFLSSQKNRPSLFGMPLIVPCTVHTRKKDLYDAVWIQVSRLASPLPPQEASNHAQDCDDSMGYQYPFTLRVVQKDGNSCAWCPWYRFCRGCKIDCGEDRAFIGNAYIAVDWDPTALHLRYQTSQERVVDEHESVEQSRRAQAEPINLDSCLRAFTSEEELGENEMYYCSKCKTHCLATKKLDLWRLPPILIIHLKRFQFVNGRWIKSQKIVKFPRESFDPSAFLVPRDPALCQHKPLTPQGDELSEPRILAREVKKVDAQSSAGEEDVLLSKSPSSLSANIISSPKGSPSSSRKSGTSCPSSKNSSPNSSPRTLGRSKGRLRLPQIGSKNKLSSSKENLDASKENGAGQICELADALSRGHVLGGSQPELVTPQDHEVALANGFLYEHEACGNGYSNGQLGNHSEEDSTDDQREDTRIKPIYNLYAISCHSGILGGGHYVTYAKNPNCKWYCYNDSSCKELHPDEIDTDSAYILFYEQQGIDYAQFLPKTDGKKMADTSSMDEDFESDYKKYCVLQ

SEQ ID NO: 68999 - protein, 390 aa, Homo sapiens
MGAKESRIGFLSYEEALRRVTDVELKRLKDAFKRTCGLSYYMGQHCFIREVLGDGVPPKVAEVIYCSFGGTSKGLHFNNLIVGLVLLTRGKDEEKAKYIFSLFSSESGNYVIREEMERMLHVVDGKVPDTLRKCFSEGEKVNYEKFRNWLFLNKDAFTFSRWLLSGGVYVTLTDDSDTPTFYQTLAGVTHLEESDIIDLEKRYWLLKAQSRTGRFDLETFGPLVSPPIRPSLSEGLFNAFDENRDNHIDFKEISCGLSACCRGPLAERQKFCFKVFDVDRDGVLSRVELRDMVVALLEVWKDNRTDDIPELHMDLSDIVEGILNAHDTTKMGHLTLEDYQIWSVKNVLANEFLNLLFQVCHIVLGLRPATPEEEGQIIRTLETDQIYTRN

SEQ ID NO: 69000 - protein, 1123 aa, Homo sapiens
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSCHQGSFCMLCVMQNHIVQAFANSGNAIKPVSFIRDLKKIARHFRFGNQEDAHEFLRYTIDAMQKACLNGCAKLDRQTQATTLVHQIFGGYLRSRVKCSVCKSVSDTYDPYLDVALEIRQAANIVRALELFVKADVLSGENAYMCAKCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRIPGSKKSPEGLISRTGSSSLPGRPSVIPDHSKKNIGNGIISSPLTGKRQDSGTMKKPHTTEEIGVPISRNGSTLGLKSQNGCIPPKLPSGSPSPKLSQTPTHMPTILDDPGKKVKKPAPPQHFSPRTAQGLPGTSNSNSSRSGSQRQGSWDSRDVVLSTSPKLLATATANGHGLKGNDESAGLDRRGSSSSSPEHSASSDSTKAPQTPRSGAAHLCDSQETNCSTAGHSKTPPSGADSKTVKLKSPVLSNTTTEPASTMSPPPAKKLALSAKKASTLWRATGNDLRPPPPSPSSDLTHPMKTSHPVVASTWPVHRARAVSPAPQSSSRLQPPFSPHPTLLSSTPKPPGTSEPRSCSSISTALPQVNEDLVSLPHQLPEASEPPQSPSEKRKKTFVGEPQRLGSETRLPQHIREATAAPHGKRKRKKKKRPEDTAASALQEGQTQRQPGSPMYRREGQAQLPAVRRQEDGTQPQVNGQQVGCVTDGHHASSRKRRRKGAEGLGEEGGLHQDPLRHSCSPMGDGDPEAMEESPRKKKKKKRKQETQRAVEEDGHLKCPRSAKPQDAVVPESSSCAPSANGWCPGDRMGLSQAPPVSWNGERESDVVQELLKYSSDKAYGRKVLTWDGKMSAVSQDAIEDSRQARTETVVDDWDEEFDRGKEKKIKKFKREKRRNFNAFQKLQTRRNFWSVTHPAKAASLSYRR

SEQ ID NO: 69001 - protein, 548 aa, Homo sapiens
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSCHQGSFCMLCVMQNHIVQAFANSGNAIKPVSFIRDLKKIARHFRFGNQEDAHEFLRYTIDAMQKACLNGCAKLDRQTQATTLVHQIFGGYLRSRVKCSVCKSVSDTYDPYLDVALEIRQAANIVRALELFVKADVLSGENAYMCAKCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRIPGSKKSPEGLISRTGSSSLPGRPSVIPDHSKKNIGNGIISSPLTGKRQDSGTMKKPHTTEEIGVPISRNGSTLGLKSQNGCIPPKLPSGSPSPKLSQTPTHMPTILDDPGKKVKKPAPPLPTGMG

SEQ ID NO: 69002 - protein, 728 aa, Homo sapiens
MCAKCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRIPGSKKSPEGLISRTGSSSLPGRPSVIPDHSKKNIGNGIISSPLTGKRQDSGTMKKPHTTEEIGVPISRNGSTLGLKSQNGCIPPKLPSGSPSPKLSQTPTHMPTILDDPGKKVKKPAPPQHFSPRTAQGLPGTSNSNSSRSGSQRQGSWDSRDVVLSTSPKLLATATANGHGLKGNDESAGLDRRGSSSSSPEHSASSDSTKAPQTPRSGAAHLCDSQETNCSTAGHSKTPPSGADSKTVKLKSPVLSNTTTEPASTMSPPPAKKLALSAKKASTLWRATGNDLRPPPPSPSSDLTHPMKTSHPVVASTWPVHRARAVSPAPQSSSRLQPPFSPHPTAASALQEGQTQRQPGSPMYRREGQAQLPAVRRQEDGTQPQVNGQQVGCVTDGHHASSRKRRRKGAEGLGEEGGLHQDPLRHSCSPMGDGDPEAMEESPRKKKKKKRKQETQRAVEEDGHLKCPRSAKPQDAVVPESSSCAPSANGWCPGDRMGLSQAPPVSWNGERESDVVQELLKYSSDKAYGRKVLTWDGKMSAVSQDAIEDSRQARTETVVDDWDEEFDRGKEKKIKKFKREKRRNFNAFQKLQTRRNFWSVTHPAKAASLSYRR

SEQ ID NO: 69003 - protein, 1123 aa, Homo sapiens; identical to SEQ ID NO: 69000

SEQ ID NO: 69004 - protein, 565 aa, Homo sapiens
MSGRSKRESRGSTRGKRESESRGSSGRVKRERDREREPEAASSRGSPVRVKREFEPASAREAPASVVPFVRVKREREVDEDSEPEREVRAKNGRVDSEDRRSRHCPYLDTINRSVLDFDFEKLCSISLSHINAYACLVCGKYFQGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHGTGKWYELQDLQVTDILPQMITLSEAYIQIWKRRDNDETNQQGA

SEQ ID NO: 69005 - protein, 565 aa, Homo sapiens; identical to SEQ ID NO: 69004

SEQ ID NO: 69006 - protein, 462 aa, Homo sapiens
MLTAVPSHLFSAKNGRVDSEDRRSRHCPYLDTINSFSPFPTGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHGTGKWYELQDLQVTDILPQMITLSEAYIQIWKRRDNDETNQQGA

SEQ ID NO: 69007 - protein, 488 aa, Homo sapiens
MSGRSKRESRGSTRGKRESESRGSSGRVKRERDREREPEAASSRGSPVRVKREFEPASAREAPASVVPFVRVKREREVDEDSEPEREVRAKNGRVDSEDRRSRHCPYLDTINRSVLDFDFEKLCSISLSHINAYACLVCGKYFQGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITGQANGMNYKTSR

SEQ ID NO: 69008 - protein, 963 aa, Homo sapiens
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKSSTAPSRNFTTSPKSSASPYSSVSASLIANGDSTSTCGMHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 69009 - protein, 916 aa, Homo sapiens
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSNGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 69010 - protein, 313 aa, Homo sapiens
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKVSFFLPRLECNGAILAHCNFCLPGSSNSPASASRVAPSHLANFFFFEMESHSVTKLECGGAVSAYSRVQVMLLPQPPEWLG

SEQ ID NO: 69011 - protein, 712 aa, Homo sapiens
MLAMDTCKHVGQLQLAQDHSSLNPQKWHCVDCNTTESIWACLSCSHVACGRYIEEHALKHFQESSHPVALEVNEMYVFCYLCDDYVLNDNTTGDLKLLRRTLSAIKSQNYHCTTRSGRFLRSMGTGDDSYFLHDGAQSLLQSEDQLYTALWHRRRILMGKIFRTWFEQSPIGRKKQEEPFQEKIVVKREVKKRRQELEYQVKAELESMPPRKSLRLQGLAQSTIIEIVSVQVPAQTPASPAKDKVLSTSENEISQKVSDSSVKRRPIVTPGVTGLRNLGNTCYMNSVLQVLSHLLIFRQCFLKLDLNQWLAMTASEKTRSCKHPPVTDTVVYQMNECQEKDTGFVCSRQSSLSSGLSGGASKGRKMELIQPKEPTSQYISLCHELHTLFQVMWSGKWALVSPFAMLHSVWRLIPAFRGYAQQDAQEFLCELLDKIQRELETTGTSLPALIPTSQRKLIKQVLNVVNNIFHGQLLSQVTCLACDNKSNTIEPFWDLSLEFPERYQCSGKDIASQPCLVTEMLAKFTETEALEGKIYVCDQCNSKRRRFSSKPVVLTEAQKQLMICHLPQVLRLHLKRFRWSGRNNREKIGVHVGFEEILNMEPYCCRETLKSLRPECFIYDLSAVVMHHGKGFGSGHYTAYCYNSEGGFWVHCNDSKLSMCTMDEVCKAQAYILFYTQRVTENGHSKLLPPELLLGSQHPNEDADTSSNEILS

SEQ ID NO: 69012 - protein, 712 aa, Homo sapiens; identical to SEQ ID NO: 69011

SEQ ID NO: 69013 - protein, 712 aa, Homo sapiens; identical to SEQ ID NO: 69011

SEQ ID NO: 69014 - protein, 111 aa, Homo sapiens
MLAMDTCKHVGQLQLAQDHSSLNPQKWHCVDCNTTESIWACLSCSHVACGRYIEEHALKHFQESSHPVALEVNEMYVFCYLCDDYVLNDNTTGDLKLLRRTLSAIKSQNYH

SEQ ID NO: 69015 - protein, 164 aa, Homo sapiens
MLAMDTCKHVGQLQLAQDHSSLNPQKWHCVDCNTTESIWACLSCSHVACGRYIEEHALKHFQESSHPVALEVNEMYVFCYLCDDYVLNDNTTGDLKLLRRTLSAIKSQNYHCTTRSGRFLRSMGTGDDSYFLHDGAQSLLQSEDQLYTALWHRRRILMGKIFRT

SEQ ID NO: 69016 - protein, 366 aa, Homo sapiens
MTVRNIASICNMGTNASALEKDIGPEQFPINEHYFGLVNFGNTCYCNSVLQALYFCRPFRENVLAYKAQQKKKENLLTCLADLFHSIATQKKKVGVIPPKKFISRLRKENDLFDNYMQQDAHEFLNYLLNTIADILQEEKKQEKQNGKLKNGNMNEPAENNKPELTWVHEIFQGTLTNETRCLNCETVSSKDEDFLDLSVDVEQNTSITHCLRDFSNTETLCSEQKYYCETCCSKQEAQKRMRVKKLPMILALHLKRFKYMEQLHRYTKLSYRVVFPLELRLFNTSSDAVNLDRMYDLVAVVVHCGSGPNRGHYITIVKSHGFWLLFDDDIVEKIDAQAIEEFYGLTSDISKNSESGYILFYQSRE

SEQ ID NO: 69017 - protein, 359 aa, Homo sapiens
MNCFQGTNASALEKDIGPEQFPINEHYFGLVNFGNTCYCNSVLQALYFCRPFRENVLAYKAQQKKKENLLTCLADLFHSIATQKKKVGVIPPKKFISRLRKENDLFDNYMQQDAHEFLNYLLNTIADILQEEKKQEKQNGKLKNGNMNEPAENNKPELTWVHEIFQGTLTNETRCLNCETVSSKDEDFLDLSVDVEQNTSITHCLRDFSNTETLCSEQKYYCETCCSKQEAQKRMRVKKLPMILALHLKRFKYMEQLHRYTKLSYRVVFPLELRLFNTSSDAVNLDRMYDLVAVVVHCGSGPNRGHYITIVKSHGFWLLFDDDIVEKIDAQAIEEFYGLTSDISKNSESGYILFYQSRE

SEQ ID NO: 69018 - protein, 1406 aa, Homo sapiens
MDMVENADSLQAQERKDILMKYDKGHRAGLPEDKGPEPVGINSSIDRFGILHETELPPVTAREAKKIRREMTRTSKWMEMLGEWETYKHSSKLIDRVYKGIPMNIRGPVWSVLLNIQEIKLKNPGRYQIMKERGKRSSEHIHHIDLDVRTTLRNHVFFRDRYGAKQRELFYILLAYSEYNPEVGYCRDLSHITALFLLYLPEEDAFWALVQLLASERHSLPGFHSPNGGTVQGLQDQQEHVVPKSQPKTMWHQDKEGLCGQCASLGCLLRNLIDGISLGLTLRLWDVYLVEGEQVLMPITSIALKVQQKRLMKTSRCGLWARLRNQFFDTWAMNDDTVLKHLRASTKKLTRKQGDLPPPAKREQGSLAPRPVPASRGGKTLCKGYRQAPPGPPAQFQRPICSASPPWASRFSTPCPGGAVREDTYPVGTQGVPSLALAQGGPQGSWRFLEWKSMPRLPTDLDIGGPWFPHYDFEWSCWVRAISQEDQLATCWQAEHCGEVHNKDMSWPEEMSFTANSSKIDRQKVPTEKGATGLSNLGNTCFMNSSIQCVSNTQPLTQYFISGRHLYELNRTNPIGMKGHMAKCYGDLVQELWSGTQKSVAPLKLRRTIAKYAPKFDGFQQQDSQELLAFLLDGLHEDLNRVHEKPYVELKDSDGRPDWEVAAEAWDNHLRRNRSIIVDLFHGQLRSQVKCKTCGHISVRFDPFNFLSLPLPMDSYMDLEITVIKLDGTTPVRYGLRLNMDEKYTGLKKQLRDLCGLNSEQILLAEVHDSNIKNFPQDNQKVQLSVSGFLCAFEIPVPSSPISASSPTQIDFSSSPSTNGMFTLTTNGDLPKPIFIPNGMPNTVVPCGTEKNFTNGMVNGHMPSLPDSPFTGYIIAVHRKMMRTELYFLSPQENRPSLFGMPLIVPCTVHTRKKDLYDAVWIQVSWLARPLPPQEASIHAQDRDNCMGYQYPFTLRVVQKDGNSCAWCPQYRFCRGCKIDCGEDRAFIGNAYIAVDWHPTALHLRYQTSQERVVDKHESVEQSRRAQAEPINLDSCLRAFTSEEELGESEMYYCSKCKTHCLATKKLDLWRLPPFLIIHLKRFQFVNDQWIKSQKIVRFLRESFDPSAFLVPRDPALCQHKPLTPQGDELSKPRILAREVKKVDAQSSAGKEDMLLSKSPSSLSANISSSPKGSPSSSRKSGTSCPSSKNSSPNSSPRTLGRSKGRLRLPQIGSKNKPSSSKKNLDASKENGAGQICELADALSRGHMRGGSQPELVTPQDHEVALANGFLYEHEACGNGCGDGYSNGQLGNHSEEDSTDDQREDTHIKPIYNLYAISCHSGILSGGHYITYAKNPNCKWYCYNDSSCEELHPDEIDTDSAYILFYEQQGIDYAQFLPKIDGKKMADTSSTDEDSESDYEKYSMLQ

SEQ ID NO: 69019 - protein, 1089 aa, Homo sapiens
MPQRLPHARQHTPLPLGSADYRRVVSVRPQGPHRDPKDSRDAAKREQGSLAPRPVPASRGGKTLCKGYRQAPPGPPAQFQRPICSASPPWASRFSTPCPGGAVREDTYPVGTQGVPSLALAQGGPQGSWRFLEWKSMPRLPTDLDIGGPWFPHYDFEWSCWVRAISQEDQLATCWQAEHCGEVHNKDMSWPEEMSFTANSSKIDRQKVPTEKGATGLSNLGNTCFMNSSIQCVSNTQPLTQYFISGRHLYELNRTNPIGMKGHMAKCYGDLVQELWSGTQKSVAPLKLRRTIAKYAPKFDGFQQQDSQELLAFLLDGLHEDLNRVHEKPYVELKDSDGRPDWEVAAEAWDNHLRRNRSIIVDLFHGQLRSQVKCKTCGHISVRFDPFNFLSLPLPMDSYMDLEITVIKLDGTTPVRYGLRLNMDEKYTGLKKQLRDLCGLNSEQILLAEVHDSNIKNFPQDNQKVQLSVSGFLCAFEIPVPSSPISASSPTQIDFSSSPSTNGMFTLTTNGDLPKPIFIPNGMPNTVVPCGTEKNFTNGMVNGHMPSLPDSPFTGYIIAVHRKMMRTELYFLSPQENRPSLFGMPLIVPCTVHTRKKDLYDAVWIQVSWLARPLPPQEASIHAQDRDNCMGYQYPFTLRVVQKDGNSCAWCPQYRFCRGCKIDCGEDRAFIGNAYIAVDWHPTALHLRYQTSQERVVDKHESVEQSRRAQAEPINLDSCLRAFTSEEELGESEMYYCSKCKTHCLATKKLDLWRLPPFLIIHLKRFQFVNDQWIKSQKIVRFLRESFDPSAFLVPRDPALCQHKPLTPQGDELSKPRILAREVKKVDAQSSAGKEDMLLSKSPSSLSANISSSPKGSPSSSRKSGTSCPSSKNSSPNSSPRTLGRSKGRLRLPQIGSKNKPSSSKKNLDASKENGAGQICELADALSRGHMRGGSQPELVTPQDHEVALANGFLYEHEACGNGCGDGYSNGQLGNHSEEDSTDDQREDTHIKPIYNLYAISCHSGILSGGHYITYAKNPNCKWYCYNDSSCEELHPDEIDTDSAYILFYEQQGIDYAQFLPKIDGKKMADTSSTDEDSESDYEKYSMLQ

SEQ ID NO: 69020 - protein, 786 aa, Homo sapiens
MDMVENADSLQAQERKDILMKYDKGHRAGLPEDKGPEPVGINSSIDRFGILHETELPPVTAREAKKIRREMTRTSKWMEMLGEWETYKHSSKLIDRVYKGIPMNIRGPVWSVLLNIQEIKLKNPGRYQIMKERGKRSSEHIHHIDLDVRTTLRNHVFFRDRYGAKQRELFYILLAYSEYNPEVGYCRDLSHITALFLLYLPEEDAFWALVQLLASERHSLPGFHSPNGGTVQGLQDQQEHVVPKSQPKTMWHQDKEGLCGQCASLGCLLRNLIDGISLGLTLRLWDVYLVEGEQVLMPITSIALKVQQKRLMKTSRCGLWARLRNQFFDTWAMNDDTVLKHLRASTKKLTRKQGDLPPPAKREQGSLAPRPVPASRGGKTLCKGYRQAPPGPPAQFQRPICSASPPWASRFSTPCPGGAVREDTYPVGTQGVPSLALAQGGPQGSWRFLEWKSMPRLPTDLDIGGPWFPHYDFEWSCWVRAISQEDQLATCWQAEHCGEVHNKDMSWPEEMSFTANSSKIDRQKVPTEKGATGLSNLGNTCFMNSSIQCVSNTQPLTQYFISGRHLYELNRTNPIGMKGHMAKCYGDLVQELWSGTQKSVAPLKLRRTIAKYAPKFDGFQQQDSQELLAFLLDGLHEDLNRVHEKPYVELKDSDGRPDWEVAAEAWDNHLRRNRSIIVDLFHGQLRSQVKCKTCGHISVRFDPFNFLSLPLPMDSYMDLEITVIKLDGTTPVRYGLRLNMDEKYTGLKKQLRDLCGLNSEQILLAEVHDSNIKISPLHHLQMECSP

SEQ ID NO: 69021 - protein, 27 aa, Homo sapiens
MDMVENADSLQAQERKDILMKYDKGHR

SEQ ID NO: 69022 - protein, 57 aa, Homo sapiens
MDMVENADSLQAQERKDILMKYDKGHRAGLPEDKGSPLESTAALIVLAFCMRRSCLL

SEQ ID NO: 69023 - protein, 1102 aa, Homo sapiens
MNHQQQQQQQKAGEQQLSEPEDMEMEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 69024 - protein, 1110 aa, Homo sapiens
CSHSDVGERTSPIPQQRPLQSHAEMAGNHRLGLEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 69025 - protein, 1003 aa, Homo sapiens
MVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 69026 - protein, 509 aa, Homo sapiens
MEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLTVGGAITRREKDRGSEAEGAAGSPSLYASADSRRGPVLWPPRE

SEQ ID NO: 69027 - protein, 2570 aa, Homo sapiens
MTATTRGSPVGGNDNQGQAPDGQSQPPLQQNQTSSPDSSNENSPATPPDEQGQGDAPPQLEDEEPAFPHTDLAKLDDMINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHLFDCFKASWTNASKKQREKLLELIRRLAEDDKDGVMAHKVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEVKKATSVQQIEMEESKEPDDQDAPDEHESPPPEDAPLYPHSPGSQYQQNNHVHGQPYTGPAAHHMNNPQRTGQRAQENYEGSEEVSPPQTKDQ

SEQ ID NO: 69028 - protein, 2554 aa, Homo sapiens
MTATTRGSPVGGNDNQGQAPDGQSQPPLQQNQTSSPDSSNENSPATPPDEQGQGDAPPQLEDEEPAFPHTDLAKLDDMINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHLFDCFKASWTNASKKQREKLLELIRRLAEDDKDGVMAHKVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEEPDDQDAPDEHESPPPEDAPLYPHSPGSQYQQNNHVHGQPYTGPAAHHMNNPQRTGQRAQENYEGSEEVSPPQTKDQ

SEQ ID NO: 69029 - protein, 2555 aa, Homo sapiens
MTAITHGSPVGGNDSQGQVLDGQSQHLFQQNQTSSPDSSNENSVATPPPEEQGQGDAPPQHEDEEPAFPHTELANLDDMINRPRWVVPVLPKGELEVLLEAAIDLSVKGLDVKSEACQRFFRDGLTISFTKILMDEAVSGWKFEIHRCIINNTHRLVELCVAKLSQDWFPLLELLAMALNPHCKFHIYNGTRPCELISSNAQLPEDELFARSSDPRSPKGWLVDLINKFGTLNGFQILHDRFFNGSALNIQIIAALIKPFGQCYEFLSQHTLKKYFIPVIEIVPHLLENLTDEELKKEAKNEAKNDALSMIIKSLKNLASRISGQDETIKNLEIFRLKMILRLLQISSFNGKMNALNEINKVISSVSYYTHRHSNPEEEEWLTAERMAEWIQQNNILSIVLQDSLHQPQYVEKLEKILRFVIKEKALTLQDLDNIWAAQAGKHEAIVKNVHDLLAKLAWDFSPGQLDHLFDCFKASWTNASKKQREKLLELIRRLAEDDKDGVMAHKVLNLLWNLAQSDDVPVDIMDLALSAHIKILDYSCSQDRDAQKIQWIDHFIEELRTNDKWVIPALKQIREICSLFGEASQNLSQTQRSPHIFYRHDLINQLQQNHALVTLVAENLATYMNSIRLYAGDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCRERKLIAKRRSYMMDDLELIGLDYLWRVVIQSSDEIANRAIDLLKEIYTNLGPRLKANQVVIHEDFIQSCFDRLKASYDTLCVFDGDKNSINCARQEAIRMVRVLTVIKEYINECDSDYHKERMILPMSRAFRGKHLSLIVRFPNQGRQVDELDIWSHTNDTIGSVRRCIVNRIKANVAHKKIELFVGGELIDSEDDRKLIGQLNLKDKSLITAKLTQINFNMPSSPDSSSDSSTASPGNHRNHYNDGPNLEVESCLPGVIMSVHPRYISFLWQVADLGSNLNMPPLRDGARVLMKLMPPDRTAVEKLRAVCLDHAKLGEGKLSPPLDSLFFGPSASQVLYLTEVVYALLMPAGVPLTDGSSDFQVHFLKSGGLPLVLSMLIRNNFLPNTDMETRRGAYLNALKIAKLLLTAIGYGHVRAVAEACQPVVDGTDPITQINQVTHDQAVVLQSALQSIPNPSSECVLRNESILLAQEISNEASRYMPDICVIRAIQKIIWASACGALGLVFSPNEEITKIYQMTTNGSNKLEVEDEQVCCEALEVMTLCFALLPTALDALSKEKAWQTFIIDLLLHCPSKTVRQLAQEQFFLMCTRCCMGHRPLLFFITLLFTILGSTAREKGKYSGDYFTLLRHLLNYAYNGNINIPNAEVLLVSEIDWLKRIRDNVKNTGETGVEEPILEGHLGVTKELLAFQTSEKKYHFGCEKGGANLIKELIDDFIFPASKVYLQYLRSGELPAEQAIPVCSSPVTINAGFELLVALAIGCVRNLKQIVDCLTEMYYMGTAITTCEALTEWEYLPPVGPRPPKGFVGLKNAGATCYMNSVIQQLYMIPSIRNSILAIEGTGSDLHDDMFGDEKQDSESNVDPRDDVFGYPHQFEDKPALSKTEDRKEYNIGVLRHLQVIFGHLAASQLQYYVPRGFWKQFRLWGEPVNLREQHDALEFFNSLVDSLDEALKALGHPAILSKVLGGSFADQKICQGCPHRYECEESFTTLNVDIRNHQNLLDSLEQYIKGDLLEGANAYHCEKCDKKVDTVKRLLIKKLPRVLAIQLKRFDYDWERECAIKFNDYFEFPRELDMGPYTVAGVANLERDNVNSENELIEQKEQSDNETAGGTKYRLVGVLVHSGQASGGHYYSYIIQRNGKDDQTDHWYKFDDGDVTECKMDDDEEMKNQCFGGEYMGEVFDHMMKRMSYRRQKRWWNAYILFYEQMDMIDEDDEMIRYISELTIARPHQIIMSPAIERSVRKQNVKFMHNRLQYSLEYFQFVKKLLTCNGVYLNPAPGQDYLLPEAEEITMISIQLAARFLFTTGFHTKKIVRGPASDWYDALCVLLRHSKNVRFWFTHNVLFNVSNRFSEYLLECPSAEVRGAFAKLIVFIAHFSLQDGSCPSPFASPGPSSQACDNLSLSDHLLRATLNLLRREVSEHGHHLQQYFNLFVMYANLGVAEKTQLLKLNVPATFMLVSLDEGPGPPIKYQYAELGKLYSVVSQLIRCCNVSSTMQSSINGNPPLPNPFGDLNLSQPIMPIQQNVLDILFVRTSYVKKIIEDCSNSEDTIKLLRFCSWENPQFSSTVLSELLWQVAYSYTYELRPYLDLLFQILLIEDSWQTHRIHNALKGIPDDRDGLFDTIQRSKNHYQKRAYQCIKCMVALFSSCPVAYQILQGNGDLKRKWTWAVEWLGDELERRPYTGNPQYSYNNWSPPVQSNETANGYFLERSHSARMTLAKACELCPEEEPDDQDAPDEHEPSPSEDAPLYPHSPASQYQQNNHVHGQPYTGPAAHHLNNPQKTGQRTQENYEGNEEVSSPQMKDQ

SEQ ID NO: 69030 - protein, 237 aa, Homo sapiens
  MOD_RES (1)..(1): Any amino acid
XLLKTAVTQRIPSNYFAFALGRILSSHLLSSANFSGRIHNALKGIPDDRDGLFDTIQRSKNHYQKRAYQCIKCMVALFSSCPVAYQILQGNGDLKRKWTWAVEWLGDELERRPYTGNPQYSYNNWSPPVQSNETANGYFLERSHSARMTLAKACELCPEEEPDDQDAPDEHEPSPSEDAPLYPHSPASQYQQNNHVHGQPYTGPAAHHLNNPQKTGQRTQENYEGNEEVSSPQMKDQ

SEQ ID NO: 69031 - protein, 1066 aa, Homo sapiens
MTDQENNNNISSNPFAALFGSLADAKQFAAIQKEQLKQQSDELPASPDDSDNSVSESLDEFDYSVAEISRSFRSQQEICEQLNINHMIQRIFLITLDNSDPSLKSGNGIPSRCVYLEEMAVELEDQDWLDMSNVEQALFARLLLQDPGNHLINMTSSTTLNLSADRDAGERHIFCYLYSCFQRAKEEITKVPENLLPFAVQCRNLTVSNTRTVLLTPEIYVDQNIHEQLVDLMLEAIQGAHFEDVTEFLEEVIEALILDEEVRTFPEVMIPVFDILLGRIKDLELCQILLYAYLDILLYFTRQKDMAKVFVEYIQPKDPTNGQMYQKTLLGVILSISCLLKTPGVVENHGYFLNPSRSSPQEIKVQEANIHQFMAQFHEKIYQMLKNLLQLSPETKHCILSWLGNCLHANAGRTKIWANQMPEIFFQMYASDAFFLNLGAALLKLCQPFCKPRSSRLLTFNPTYCALKELNDEERKIKNVHMRGLDKETCLIPAVQEPKFPQNYNLVTENLALTEYTLYLGFHRLHDQMVKINQNLHRLQVAWRDAQQSSSPAADNLREQFERLMTIYLSTKTAMTEPQMLQNCLNLQVSMAVLLVQLAIGNEGSQPIELTFPLPDGYSSLAYVPEFFADNLGDFLIFLRRFADDILETSADSLEHVLHFITIFTGSIERMKNPHLRAKLAEVLEAVMPHLDQTPNPLVSSVFHRKRVFCNFQYAPQLAEALIKVFVDIEFTGDPHQFEQKFNYRRPMYPILRYMWGTDTYRESIKDLADYASKNLEAMNPPLFLRFLNLLMNDAIFLLDEAIQYLSKIKIQQIEKDRGEWDSLTPEARREKEAGLQMFGQLARFHNIMSNETIGTLAFLTSEIKSLFVHPFLAERIISMLNYFLQHLVGPKMGALKVKDFSEFDFKPQQLVSDICTIYLNLGDEENFCATVPKDGRSYSPTLFAQTVRVLKKINKPGNMIMAFSNLAERIKSLADLQQQEEETYADACDEFLDPIMSTLMCDPVVLPSSRVTVDRSTIARHLLSDQTDPFNRSPLTMDQIRPNTELKEKIQRWLAERKQQKEQLE

SEQ ID NO: 69032 - protein, 1073 aa, Homo sapiens
MTDQENNNNISSNPFAALFGSLADAKQFAAIQKEQLKQQSDELPASPDDSDNSVSESLDEFDYSVAEISRSFRSQQEICEQLNINHMIQRIFLITLDNSDPSLKSGNGIPSRCVYLEEMAVELEDQDWLDMSNVEQALFARLLLQDPGNHLINMTSSTTLNLSADRDAGERHIFCYLYSCFQRAKEEITKVPENLLPFAVQCRNLTVSNTRTVLLTPEIYVDQNIHEQLVDLMLEAIQGAREYMNKIYFEDVTEFLEEVIEALILDEEVRTFPEVMIPVFDILLGRIKDLELCQILLYAYLDILLYFTRQKDMAKVFVEYIQPKDPTNGQMYQKTLLGVILSISCLLKTPGVVENHGYFLNPSRSSPQEIKVQEANIHQFMAQFHEKIYQMLKNLLQLSPETKHCILSWLGNCLHANAGRTKIWANQMPEIFFQMYASDAFFLNLGAALLKLCQPFCKPRSSRLLTFNPTYCALKELNDEERKIKNVHMRGLDKETCLIPAVQEPKFPQNYNLVTENLALTEYTLYLGFHRLHDQMVKINQNLHRLQVAWRDAQQSSSPAADNLREQFERLMTIYLSTKTAMTEPQMLQNCLNLQVSMAVLLVQLAIGNEGSQPIELTFPLPDGYSSLAYVPEFFADNLGDFLIFLRRFADDILETSADSLEHVLHFITIFTGSIERMKNPHLRAKLAEVLEAVMPHLDQTPNPLVSSVFHRKRVFCNFQYAPQLAEALIKVFVDIEFTGDPHQFEQKFNYRRPMYPILRYMWGTDTYRESIKDLADYASKNLEAMNPPLFLRFLNLLMNDAIFLLDEAIQYLSKIKIQQIEKDRGEWDSLTPEARREKEAGLQMFGQLARFHNIMSNETIGTLAFLTSEIKSLFVHPFLAERIISMLNYFLQHLVGPKMGALKVKDFSEFDFKPQQLVSDICTIYLNLGDEENFCATVPKDGRSYSPTLFAQTVRVLKKINKPGNMIMAFSNLAERIKSLADLQQQEEETYADACDEFLDPIMSTLMCDPVVLPSSRVTVDRSTIARHLLSDQTDPFNRSPLTMDQIRPNTELKEKIQRWLAERKQQKEQLE

SEQ ID NO: 69033 - protein, 538 aa, Homo sapiens
MVKINQNLHRLQVAWRDAQQSSSPAADNLREQFERLMTIYLSTKTAMTEPQMLQNCLNLQVSMAVLLVQLAIGNEGSQPIELTFPLPDGYSSLAYVPEFFADNLGDFLIFLRRFADDILETSADSLEHVLHFITIFTGSIERMKNPHLRAKLAEVLEAVMPHLDQTPNPLVSSVFHRKRVFCNFQYAPQLAEALIKVFVDIEFTGDPHQFEQKFNYRRPMYPILRYMWGTDTYRESIKDLADYASKNLEAMNPPLFLRFLNLLMNDAIFLLDEAIQYLSKIKIQQIEKDRGEWDSLTPEARREKEAGLQMFGQLARFHNIMSNETIGTLAFLTSEIKSLFVHPFLAERIISMLNYFLQHLVGPKMGALKVKDFSEFDFKPQQLVSDICTIYLNLGDEENFCATVPKDGRSYSPTLFAQTVRVLKKINKPGNMIMAFSNLAERIKSLADLQQQEEETYADACDEFLDPIMSTLMCDPVVLPSSRVTVDRSTIARHLLSDQTDPFNRSPLTMDQIRPNTELKEKIQRWLAERKQQKEQLE

SEQ ID NO: 69034 - protein, 1173 aa, Homo sapiens
MEELSADEIRRRRLARLAGGQTSQPTTPLTSPQRENPPGPPIAASAPGPSQSLGLNVHNMTPATSPIGASGVAHRSQSSEGVSSLSSSPSNSLETQSQSLSRSQSMDIDGVSCEKSMSQVDVDSGIENMEVDENDRREKRSLSDKEPSSGPEVSEEQALQLVCKIFRVSWKDRDRDVIFLSSLSAQFKQNPKEVFSDFKDLIGQILMEVLMMSTQTRDENPFASLTATSQPIAAAARSPDRNLLLNTGSNPGTSPMFCSVASFGASSLSSLGASGGASNWDSYSDHFTIETCKETDMLNYLIECFDRVGIEEKKAPKMCSQPAVSQLLSNIRSQCISHTALVLQGSLTQPRSLQQPSFLVPYMLCRNLPYGFIQELVRTTHQDEEVFKQIFIPILQGLALAAKECSLDSDYFKYPLMALGELCETKFGKTHPVCNLVASLRLWLPKSLSPGCGRELQRLSYLGAFFSFSVFAEDDVKVVEKYFSGPAITLENTRVVSQSLQHYLELGRQELFKILHSILLNGETREAALSYMAAVVNANMKKAQMQTDDRLVSTDGFMLNFLWVLQQLSTKIKLETVDPTYIFHPRCRITLPNDETRVNATMEDVNDWLTELYGDQPPFSEPKFPTECFFLTLHAHHLSILPSCRRYIRRLRAIRELNRTVEDLKNNESQWKDSPLATRHREMLKRCKTQLKKLVRCKACADAGLLDESFLRRCLNFYGLLIQLLLRILDPAYPDITLPLNSDVPKVFAALPEFYVEDVAEFLFFIVQYSPQALYEPCTQDIVMFLVVMLCNQNYIRNPYLVAKLVEVMFMTNPAVQPRTQKFFEMIENHPLSTKLLVPSLMKFYTDVEHTGATSEFYDKFTIRYHISTIFKSLWQNIAHHGTFMEEFNSGKQFVRYINMLINDTTFLLDESLESLKRIHEVQEEMKNKEQWDQLPRDQQQARQSQLAQDERVSRSYLALATETVDMFHILTKQVQKPFLRPELGPRLAAMLNFNLQQLCGPKCRDLKVENPEKYGFEPKKLLDQLTDIYLQLDCARFAKAIADDQRSYSKELFEEVISKMRKAGIKSTIAIEKFKLLAEKVEEIVAKNARAEIDYSDAPDEFRDPLMDTLMTDPVRLPSGTIMDRSIILRHLLNSPTDPFNRQTLTESMLEPVPELKEQIQAWMREKQNSDH

SEQ ID NO: 69035 - protein, 1302 aa, Homo sapiens
MEELSADEIRRRRLARLAGGQTSQPTTPLTSPQRENPPGPPIAASAPGPSQSLGLNVHNMTPATSPIGASGVAHRSQSSEGVSSLSSSPSNSLETQSQSLSRSQSMDIDGVSCEKSMSQVDVDSGIENMEVDENDRREKRSLSDKEPSSGPEVSEEQALQLVCKIFRVSWKDRDRDVIFLSSLSAQFKQNPKEVFSDFKDLIGQILMEVLMMSTQTRDENPFASLTATSQPIAAAARSPDRNLLLNTGSNPGTSPMFCSVASFGASSLSSLYESSPAPTPSFWSSVPVMGPSLASPSRAASQLAVPSTPLSPHSAASGTAAGSQPSSPRYRPYTVTHPWASSGVSILSSSPSPPALASSPQAVPASSSRQRPSSTGPPLPPASPSATSRRPSSLRISPSLGASGGASNWDSYSDHFTIETCKETDMLNYLIECFDRVGIEEKKAPKMCSQPAVSQLLSNIRSQCISHTALVLQGSLTQPRSLQQPSFLVPYMLCRNLPYGFIQELVRTTHQDEEVFKQIFIPILQGLALAAKECSLDSDYFKYPLMALGELCETKFGKTHPVCNLVASLRLWLPKSLSPGCGRELQRLSYLGAFFSFSVFAEDDVKVVEKYFSGPAITLENTRVVSQSLQHYLELGRQELFKILHSILLNGETREAALSYMAAVVNANMKKAQMQTDDRLVSTDGFMLNFLWVLQQLSTKIKLETVDPTYIFHPRCRITLPNDETRVNATMEDVNDWLTELYGDQPPFSEPKFPTECFFLTLHAHHLSILPSCRRYIRRLRAIRELNRTVEDLKNNESQWKDSPLATRHREMLKRCKTQLKKLVRCKACADAGLLDESFLRRCLNFYGLLIQLLLRILDPAYPDITLPLNSDVPKVFAALPEFYVEDVAEFLFFIVQYSPQALYEPCTQDIVMFLVVMLCNQNYIRNPYLVAKLVEVMFMTNPAVQPRTQKFFEMIENHPLSTKLLVPSLMKFYTDVEHTGATSEFYDKFTIRYHISTIFKSLWQNIAHHGTFMEEFNSGKQFVRYINMLINDTTFLLDESLESLKRIHEVQEEMKNKEQWDQLPRDQQQARQSQLAQDERVSRSYLALATETVDMFHILTKQVQKPFLRPELGPRLAAMLNFNLQQLCGPKCRDLKVENPEKYGFEPKKLLDQLTDIYLQLDCARFAKAIADDQRSYSKELFEEVISKMRKAGIKSTIAIEKFKLLAEKVEEIVAKNARAEIDYSDAPDEFRDPLMDTLMTDPVRLPSGTIMDRSIILRHLLNSPTDPFNRQTLTESMLEPVPELKEQIQAWMREKQNSDH

SEQ ID NO: 69036 - protein, 100 aa, Homo sapiens
MEELSADEIRRRRLARLAGGQTSQPTTPLTSPQRENPPGPPIAASAPGPSQSLGLNVHNMTPATSPIGASGLGIISDDKMIKTEFGSADFMNLVDGFKIK

SEQ ID NO: 69037 - protein, 1061 aa, Homo sapiens
MSQVDVDSGIENMEVDENDRREKRSLSDKEPSSGPEVSEEQALQLVCKIFRVSWKDRDRDVIFLSSLSAQFKQNPKEVFSDFKDLIGQILMEVLMMSTQTRDENPFASLTATSQPIAAAARSPDRNLLLNTGSNPGTSPMFCSVASFGASSLSSLGASGGASNWDSYSDHFTIETCKETDMLNYLIECFDRVGIEEKKAPKMCSQPAVSQLLSNIRSQCISHTALVLQGSLTQPRSLQQPSFLVPYMLCRNLPYGFIQELVRTTHQDEEVFKQIFIPILQGLALAAKECSLDSDYFKYPLMALGELCETKFGKTHPVCNLVASLRLWLPKSLSPGCGRELQRLSYLGAFFSFSVFAEDDVKVVEKYFSGPAITLENTRVVSQSLQHYLELGRQELFKILHSILLNGETREAALSYMAAVVNANMKKAQMQTDDRLVSTDGFMLNFLWVLQQLSTKIKLETVDPTYIFHPRCRITLPNDETRVNATMEDVNDWLTELYGDQPPFSEPKFPTECFFLTLHAHHLSILPSCRRYIRRLRAIRELNRTVEDLKNNESQWKDSPLATRHREMLKRCKTQLKKLVRCKACADAGLLDESFLRRCLNFYGLLIQLLLRILDPAYPDITLPLNSDVPKVFAALPEFYVEDVAEFLFFIVQYSPQALYEPCTQDIVMFLVVMLCNQNYIRNPYLVAKLVEVMFMTNPAVQPRTQKFFEMIENHPLSTKLLVPSLMKFYTDVEHTGATSEFYDKFTIRYHISTIFKSLWQNIAHHGTFMEEFNSGKQFVRYINMLINDTTFLLDESLESLKRIHEVQEEMKNKEQWDQLPRDQQQARQSQLAQDERVSRSYLALATETVDMFHILTKQVQKPFLRPELGPRLAAMLNFNLQQLCGPKCRDLKVENPEKYGFEPKKLLDQLTDIYLQLDCARFAKAIADDQRSYSKELFEEVISKMRKAGIKSTIAIEKFKLLAEKVEEIVAKNARAEIDYSDAPDEFRGKWTHPLMDTLMTDPVRLPSGTIMDRSIILRHLLNSPTDPFNRQTLTESMLEPVPELKEQIQAWMREKQNSDH

SEQ ID NO: 69038 - protein, 170 aa, Homo sapiens
MPGEVQASYLKSQSKLSDEGRLEPRKFHCKGVKVPRNFRLLEELEEGQKGVGDGTVSWGLEDDEDMTLTRWTGMIIGPPRTIYENRIYSLKIECGPKYPEAPPFVRFVTKINMNGVNSSNGVVDPRAISVLAKWQNSYSIKVVLQELRRLMMSKENMKLPQPPEGQCYSN

SEQ ID NO: 69039 - protein, 103 aa, Homo sapiens [sequence omitted]

SEQ ID NO: 69040 - protein, 147 aa, Homo sapiens
MAATTGSGVKVPRNFRLLEELEEGQKGVGDGTVSWGLEDDEDMTLTRWTGMIIGPPRTIYENRIYSLKIECGPKYPEAPPFVRFVTKINMNGVNSSNGVVDPRAISVLAKWQNSYSIKVVLQELRRLMMSKENMKLPQPPEGQCYSN

SEQ ID NO: 69041 - protein, 170 aa, Homo sapiens; identical to SEQ ID NO: 69038

SEQ ID NO: 69042 - protein, 103 aa, Homo sapiens
MKEDLNLENFTAKTIYENRIYSLKIECGPKYPEAPPFVRFVTKINMNGVNSSNGVVDPRAISVLAKWQNSYSIKVVLQELRRLMMSKENMKLPQPPEGQCYSN

SEQ ID NO: 69043 - protein, 103 aa, Homo sapiens; identical to SEQ ID NO: 69042

SEQ ID NO: 69044 - protein, 105 aa, Homo sapiens
MAATTGSGVKVPRNFRLLEELEEGQKGVGDGTVSWGLEDDEDMTLTRWTGMIIGPPRVDPRAISVLAKWQNSYSIKVVLQELRRLMMSKENMKLPQPPEGQCYSN

SEQ ID NO: 69045 - protein, 122 aa, Homo sapiens
MSTPARRRLMRDFKRLQEDPPAGVSGAPSENNIMVWNAVIFGPEGTPFEDVYADGSICLDILQNRWSPTYDVSSILTSIQSLLDEPNPNSPANSQAAQLYQENKREYEKRVSAIVEQSWRDC

SEQ ID NO: 69046 - protein, 152 aa, Homo sapiens
MSTPARRRLMRDFKRLQEDPPAGVSGAPSENNIMVWNAVIFGPEGTPFEDGTFKLTIEFTEEYPNKPPTVRFVSKMFHPNVYADGSICLDILQNRWSPTYDVSSILTSIQSLLDEPNPNSPANSQAAQLYQENKREYEKRVSAIVEQSWRDC

SEQ ID NO: 69047 - protein, 77 aa, Homo sapiens
MFHPNVYADGSICLDILQNRWSPTYDVSSILTSIQSLLDEPNPNSPANSQAAQLYQENKREYEKRVSAIVEQSWRDC

SEQ ID NO: 69048 - protein, 152 aa, Homo sapiens
MSTPARRRLMRDFKRLQEDPPVGVSGAPSENNIMQWNAVIFGPEGTPFEDGTFKLVIEFSEEYPNKPPTVRFLSKMFHPNVYADGSICLDILQNRWSPTYDVSSILTSIQSLLDEPNPNSPANSQAAQLYQENKREYEKRVSAIVEQSWNDS

SEQ ID NO: 69049 - protein, 50 aa, Homo sapiens
MASQNRDPAATSVAAARKGAEPSGGAARGPVGKRLQQELMTLMNPTLIVP

SEQ ID NO: 69050 - protein, 161 aa, Homo sapiens
MASQNRDPAATSVAAARKGAEPSGGAARGPVGKRLQQELMTLMMSGDKGISAFPESDNLFKWVGTIHGAAGTAVGSIRTSSTVCLLSGPRETQDSSKPLVWGLGWDMRLLLELTLQLFLQMPEPNIDSPLNTHAAELWKNPTAFKKYLQETYSKQVTSQEP

SEQ ID NO: 69051 - protein, 150 aa, Homo sapiens
MASQNRDPAATSVAAARKGAEPSGGAARGPVGKRLQQELMTLMVYEDLRYKLSLEFPSGYPYNAPTVKFLTPCYHPNVDTQGNICLDILKEKWSALYDVRTILLSIQSLLGEPNIDSPLNTHAAELWKNPTAFKKYLQETYSKQVTSQEP

SEQ ID NO: 69052 - protein, 179 aa, Homo sapiens
MASQNRDPAATSVAAARKGAEPSGGAARGPVGKRLQQELMTLMMSGDKGISAFPESDNLFKWVGTIHGAAGTVYEDLRYKLSLEFPSGYPYNAPTVKFLTPCYHPNVDTQGNICLDILKEKWSALYDVRTILLSIQSLLGEPNIDSPLNTHAAELWKNPTAFKKYLQETYSKQVTSQEP

SEQ ID NO: 69053 - protein, 140 aa, Homo sapiens
MTLMMSGDKGISAFPESDNLFKWVGTIHGAAGTVYEDLRYKLSLEFPSGYPYNAPTVKFLTPCYHPNVDTQGNICLDILKEKWSALYDVRTILLSIQSLLGEPNIDSPLNTHAAELWKNPTAFKKYLQETYSKQVTSQEP

SEQ ID NO: 69054 - protein, 140 aa, Homo sapiens; identical to SEQ ID NO: 69053

SEQ ID NO: 69055 - protein, 37 aa, Homo sapiens
MAASAAETRVFLEVRGQLQSALLILGDRVSPYCPCWS

SEQ ID NO: 69056 - protein, 389 aa, Homo sapiens
MAASAAETRVFLEVRGQLQSALLILGEPKEGGMPMNISIMPSSLQMKTPEGCTEIQLPAEVRLVPSSCRGLQFVVGDGLHLRLQTQAKLGTKLISMFNQSSQTQECCTFYCQSCGEVIIKDRKLLRVLPLPSENWGALVGEWCCHPDPFANKSLHPQENDCFIGDSFFLVNLRTSLWQQRPELSPVEMCCVSSDNHCKLEPKANTKVICKRCKVMLGETVSSETTKFYMTEIIIQSSERSFPIIPRSWFVQSVIAQCLVQLSSARSTFRFTIQGQDDKVYILLWLLNSDSLVIESLRNSKYIKKFPLLENTFKADSSSAWSAVKVLYQPCIKSRNEKLVSLWESDISVHPLTLPSATCLELLLILSKSNANLPSSLRRVNSFQVAFLKM

SEQ ID NO: 69057 - protein, 147 aa, Homo sapiens
MALKRIQKELSDLQRDPPAHCSAGPVGDDLFHWQATIMGPPDSAYQGGVFFLTVHFPTDYPFKPPKIAFTTKIYHPNINSNGSICLDILRSQWSPALTVSKVLLSICSLLCDPNPDDPLVPDIAQIYKSDKEKYNRHAREWTQKYAM

SEQ ID NO: 69058 - protein, 201 aa, Homo sapiens
MSTEAQRVDDSPSTSGGSSDGDQRESVQQEPEREQVQPKKKEGKISSKTAAKLSTSAKRIQKELAEITLDPPPNCSAGPKGDNIYEWRSTILGPPGSVYEGGVFFLDITFSPDYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 69059 - protein, 201 aa, Homo sapiens; identical to SEQ ID NO: 69058

SEQ ID NO: 69060 - protein, 207 aa, Homo sapiens
MSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGGVFFLDITFSSDYPFKPPKVTFRTRIYHCNINSQGVICLDILKDNWSPALTISKVLLSICSLLTDCNPADPLVGSIATQYLTNRAEHDRIARQWTKRYAT

SEQ ID NO: 69061 - protein, 207 aa, Homo sapiens; identical to SEQ ID NO: 69060

SEQ ID NO: 69062 - protein, 207 aa, Homo sapiens; identical to SEQ ID NO: 69060

SEQ ID NO: 69063 - protein, 207 aa, Homo sapiens; identical to SEQ ID NO: 69060

SEQ ID NO: 69064 - protein, 175 aa, Homo sapiens
MSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGGVFFLDITFSSDYPFKPPKVTFRTRIYHCNINSQGVICLDILKDNWSPALTISKVLLSICSLLTDCNP

SEQ ID NO: 69065 - protein, 175 aa, Homo sapiens; identical to SEQ ID NO: 69064

SEQ ID NO: 69066 - protein, 175 aa, Homo sapiens; identical to SEQ ID NO: 69064

SEQ ID NO: 69067 - protein, 137 aa, Homo sapiens
MNEENFFEWEALIMGPEDTCFEFGVFPAILSFPLDYPLSPPKMRFTCEMFHPNIYPDGRVCISILHAPGDDPMGYESSAERWSPVQSVEKILLSVVSMLAEPNDESGANVDASKMWRDDREQFYKIAKQIVQKSLGL

SEQ ID NO: 69068 - protein, 165 aa, Homo sapiens
MAGTALKRLMAEYKQLTLNPPEGIVAGPMNEENFFEWEALIMGPEDTCFEFGVFPAILSFPLDYPLSPPKMRFTCEMFHPNIYPDGRVCISILHAPGDDPMGYESSAERWSPVQSVEKILLSVVSMLAEPNDESGANVDASKMWRDDREQFYKIAKQIVQKSLGL

SEQ ID NO: 69069 - protein, 183 aa, Homo sapiens
MSSPSPGKRRMDTDVVKLIESKHEVTILGGLNEFVVKFYGPQGTPYEGGVWKVRVDLPDKYPFKSPSIGFMNKIFHPNIDEASGTVCLDVINQTWTALYDLTNIFESFLPQLLAYPNPIDPLNGDAAAMYLHRPEEYKQKIKEYIQKYATEEALKEQEEGTGDSSSESSMSDFSEDEAQDMEL

SEQ ID NO: 69070 - protein, 152 aa, Homo sapiens
MSSPSPGKRRMDTDVVKLIESKHEVTILGGLNEFVVKFYGPQGTPYEGGVWKVRVDLPDKYPFKSPSIDLTNIFESFLPQLLAYPNPIDPLNGDAAAMYLHRPEEYKQKIKEYIQKYATEEALKEQEEGTGDSSSESSMSDFSEDEAQDMEL

SEQ ID NO: 69071 - protein, 158 aa, Homo sapiens [sequence omitted]

SEQ ID NO: 69072 - protein, 158 aa, Homo sapiens [sequence omitted]

SEQ ID NO: 69073 - protein, 158 aa, Homo sapiens [sequence omitted]

SEQ ID NO: 69074 - protein, 158 aa, Homo sapiens [sequence omitted]

SEQ ID NO: 69075 - protein, 158 aa, Homo sapiens [sequence omitted]

SEQ ID NO: 69076 - protein, 158 aa, Homo sapiens [sequence omitted]

SEQ ID NO: 69077 - protein, 154 aa, Homo sapiens [sequence omitted]

SEQ ID NO: 69078 - protein, 212 aa, Homo sapiens
MQVAAGTRGDTRLQEVALLPQLFDLLVLGQRRARLLRQVPSALAGKDLAQLQAGATLAGYRRAHGPEELEEIRKCGMKNFRNIQVDEANLLTWQGLIVPDNPPYDKGAFRIEINFPAEYPFKPPKITFKTKIYHPNIDEKGQVCLPVISAENWKPATKTDQVIQSLIALVNDPQPEHPLRADLAEEYSKDRKKFCKNAEEFTKKYGEKRPVD

SEQ ID NO: 69079 - protein, 122 aa, Homo sapiens
MAASRRLMKDNPPYDKGAFRIEINFPAEYPFKPPKITFKTKIYHPNIDEKGQVCLPVISAENWKPATKTDQVIQSLIALVNDPQPEHPLRADLAEEYSKDRKKFCKNAEEFTKKYGEKRPVD

SEQ ID NO: 69080 - protein, 153 aa, Homo sapiens
MMASMRVVKELEDLQKKPPPYLRNLSSDDANVLVWHALLLPDQPPYHLKAFNLRISFPPEYPFKPPMIKFTTKIYHPNVDENGQICLPIISSENWKPCTKTCQVLEALNVLVNRPNIREPLRMDLADLLTQNPELFRKNAEEFTLRFGVDRPS

SEQ ID NO: 69081 - protein, 87 aa, Homo sapiens
MIKFTTKIYHPNVDENGQICLPIISSENWKPCTKTCQVLEALNVLVNRPNIREPLRMDLADLLTQNPELFRKNAEEFTLRFGVDRPS

SEQ ID NO: 69082 - protein, 65 aa, Homo sapiens
MIKFTTKIYHPNVDENGQICLPIISSENWKPCTKTCQVLEALNVLVNRPNIREPLRMDLADLLTQ

SEQ ID NO: 69083 - protein, 375 aa, Homo sapiens
MSVSGLKAELKFLASIFDKNHERFRIVSWKLDELHCQFLVPQQGSPHSLPPPLTLHCNITESYPSSSPIWFVDSEDPNLTSVLERLEDTKNNNLLRQQLKWLICELCSLYNLPKHLDVEMLDQPLPTGQNGTTEEVTSEEEEEEEEMAEDIEDLDHYEMKEEEPISGKKSEDEGIEKENLAILEKIRKTQRQDHLNGAVSGSVQASDRLMKELRDIYRSQSYKTGIYSVELINDSLYDWHVKLQKVDPDSPLHSDLQILKEKEGIEYILLNFSFKDNFPFDPPFVRVVLPVLSGGYVLGGGALCMELLTKQGWSSAYSIESVIMQINATLVKGKARVQFGANKNQYNLARAQQSYNSIVQIHEKNGWYTPPKEDG

SEQ ID NO: 69084 - protein, 314 aa, Homo sapiens
MSVSGLKAELKFLASIFDKNHERFRIVSWKLDELHCQFLVPQQGSPHSLPPPLTLHCNITESYPSSSPIWFVDSEDPNLTSVLERLEDTKNNNLLRQQLKWLICELCSLYNLPKHLDVEMLDQPLPTGQNGTTEEVTSEEEEEEEEMAEDIEDLDHYEMKEEEPISGKKSEDEGIEKENLAILEKIRKTQRQDHLNGAVSGSVQASDRLMKELRDIYRSQSYKTGIYSVELINDSLYDWHVKLQKVDPDSPLHSDLQILKEKEGIEYILLNFSFKDNFPFDPPFVRVVLPVLSGGLVHPSKGRWLNVLTVVCLD

SEQ ID NO: 69085 - protein, 359 aa, Homo sapiens
MRMDSLTEEKLECRLWCCLSDPSPPGLAARCCVLERSIVPSLRQESYPSSSPIWFVDSEDPNLTSVLERLEDTKNNNLLRQQLKWLICELCSLYNLPKHLDVEMLDQPLPTGQNGTTEEVTSEEEEEEEEMAEDIEDLDHYEMKEEEPISGKKSEDEGIEKENLAILEKIRKTQRQDHLNGAVSGSVQASDRLMKELRDIYRSQSYKTGIYSVELINDSLYDWHVKLQKVDPDSPLHSDLQILKEKEGIEYILLNFSFKDNFPFDPPFVRVVLPVLSGGYVLGGGALCMELLTKQGWSSAYSIESVIMQINATLVKGKARVQFGANKNQYNLARAQQSYNSIVQIHEKNGWYTPPKEDG

SEQ ID NO: 69086 - protein, 359 aa, Homo sapiens; identical to SEQ ID NO: 69085

SEQ ID NO: 69087 - protein, 238 aa, Homo sapiens
MAQQQMTSSQKALMLELKSLQEEPVEGFRITLVDESDLYNWEVAIFGPPNTLYEGGYFKAHIKFPIDYPYSPPTFRFLTKMWHPNIYENGDVCISILHPPVDDPQSGELPSERWNPTQNVRTILLSVISLLNEPNTFSPANVDASVMFRKWRDSKGKDKEYAEIIRKQVSATKAEAEKDGVKVPTTLAEYCIKTKVPSNDNSSDLLYDDLYDDDIDDEDEEEEDADCYDDDDSGNEES

SEQ ID NO: 69088 - protein, 222 aa, Homo sapiens
MNSNVENLPPHIIRLVYKEVTTLTADPPDGIKVFPNEEDLTDLQVTIEGPEGTPYAGGLFRMKLLLGKDFPASPPKGYFLTKIFHPNVGANGEICVNVLKRDWTAELGIRHVLLTIKCLLIHPNPESALNEEAGRLLLENYEEYAARARLLTEIHGGAGGPSGRAEAGRALASGTEASSTDPGAPGGPGGAEGPMAKKHAGERDKKLAAKKKTDKKRALRRL

SEQ ID NO: 69089 - protein, 197 aa, Homo sapiens
MQRASRLKRELHMLATEPPPGITCWQDKDQMDDLRAQILGGANTPYEKGVFKLEVIIPERYPFEPPQIRFLTPIYHPNIDSAGRICLDVLKLPPKGAWRPSLNIATVLTSIQLLMSEPNPDDPLMADISSEFKYNKPAFLKNARQWTEKHARQKQKADEEEMLDNLPEAGDSRVHNSTQKRKASQLVGIEKKFHPDV

SEQ ID NO: 69090 - protein, 162 aa, Homo sapiens
MASMQTTGRRVEVWFPKRLQKELLALQNDPPPGMTLNEKSVQNSITQWIVDMEGAPGTLYEGEKFQLLFKFSSRYPFDSPQVMFTGENIPVHPHVYSNGHICLSILTEDWSPALSVQSVCLSIISMLSSCKEKRRPPDNSFYVRTCNKNPKKTKWWYHDDTC

SEQ ID NO: 69091 - protein, 159 aa, Homo sapiens
MASMQKRLQKELLALQNDPPPGMTLNEKSVQNSITQWIVDMEGAPGTLYEGEKFQLLFKFSSRYPFDSPQVMFTGENIPVHPHVYSNGHICLSILTEDWSPALSVQSVCLSIISMLSSCKEKRRPPDNSFYVRTCNKNPKKTKWWYHELKSAFILSITD

SEQ ID NO: 69092 - protein, 151 aa, Homo sapiens
MASMQKRLQKELLALQNDPPPGMTLNEKSVQNSITQWIVDMEGAPGTLYEGEKFQLLFKFSSRYPFDSPQVMFTGENIPVHPHVYSNGHICLSILTEDWSPALSVQSVCLSIISMLSSCKEKRRPPDNSFYVRTCNKNPKKTKWWYHDDTC

SEQ ID NO: 69093 - protein, 117 aa, Homo sapiens
MSSNVPADMINLRLILVSGKTKEFLFSPNDSASDIAKHVYDNWPMDWEEEQVSSPNILRLIYQGRFLHGNVTLGALKLPFGKTTVMHLVARETLPEPNSQGQRNREKTGESNCCVIL

SEQ ID NO: 69094 - protein, 157 aa, Homo sapiens
MQLTVKALQGRECSLQVPEDELVSTLKQLVSEKLNVPVRQQRLLFKGKALADGKRLSDYSIGPNSKLNLVVKPLEKVLLEEGEAQRLADSPPPQVWQLISKVLARHFSAADASRVLEQLQRDYERSLSRLTLDDIERLASRFLHPEVTETMEKGFSK

SEQ ID NO: 69095 - protein, 174 aa, Homo sapiens
MFLTVKLLLGQRCSLKVSGQESVATLKRLVSRRLKVPEEQQHLLFRGQLLEDDKHLSDYCIGPNASINVIMQPLEKMALKEAHQPQTQPLWHQLGLVLAKHFEPQDAKAVLQLLRQEHEERLQKISLEHLEQLAQYLLAEEPHVEPAGERELEAKARPQSSCDMEEKEEAAADQ

SEQ ID NO: 69096 - protein, 73 aa, Homo sapiens
MIEVVCNDRLGKKVRVKCNTDDTIGDLKKLIAAQTGTRWNKIVLKKWYTIFKDHVSLGDYEIHDGMNLELYYQ

SEQ ID NO: 69097 - protein, 73 aa, Homo sapiens; identical to SEQ ID NO: 69096

SEQ ID NO: 69098 - protein, 380 aa, Homo sapiens
MSLSDWHLAVKLADQPLTPKSILRLPETELGEYSLGGYSISFLKQLIAGKLQESVPDPELIDLIYCGRKLKDDQTLDFYGIQPGSTVHVLRKSWPEPDQKPEPVDKVAAMREFRVLHTALHSSSSYREAVFKMLSNKESLDQIIVATPGLSSDPIALGVLQDKDLFSVFADPNMLDTLVPAHPALVNAIVLVLHSVAGSAPMPGTDSSSRSMPSSSYRDMPGGFLFEGLSDDEDDFHPNTRSTPSSSTPSSRPASLGYSGAAGPRPITQSELATALALASTPESSSHTPTPGTQGHSSGTSPMSSGVQSGTPITNDLFSQALQHALQASGQPSLQSQWQPQLQQLRDMGIQDDELSLRALQATGGDIQAALELIFAGGAP

SEQ ID NO: 69099 - protein, 380 aa, Homo sapiens; identical to SEQ ID NO: 69098

SEQ ID NO: 69100 - protein, 318 aa, Homo sapiens
MALPIIVKWGGQEYSVTTLSEDDTVLDLKQFLKTLTGVLPERQKLLGLKVKGKPAENDVKLGALKLKPNTKIMMMGTREESLEDVLGPPPDNDDVVNDFDIEDEVVEVENREENLLKISRRVKEYKVEILNPPREGKKLLVLDVDYTLFDHRSCAETGVELMRPYLHEFLTSAYEDYDIVIWSATNMKWIEAKMKELGVSTNANYKITFMLDSAAMITVHTPRRGLIDVKPLGVIWGKFSEFYSKKNTIMFDDIGRNFLMNPQNGLKIRPFMKAHLNRDKDKELLKLTQYLKEIAKLDDFLDLNHKYWERYLSKKQGQ

SEQ ID NO: 69101 - protein, 640 aa, Homo sapiens
MALSRGLPRELAEAVAGGRVLVVGAGGIGCELLKNLVLTGFSHIDLIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 69102 - protein, 544 aa, Homo sapiens
MNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 69103 - protein, 292 aa, Homo sapiens
MCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTDFFE

SEQ ID NO: 69104 - protein, 348 aa, Homo sapiens
MALKRMGIVSDYEKIRTFAVAIVGVGGVGSVTAEMLTRCGIGKLLLFDYDKVELANMNRLFFQPHQAGLSKVQAAEHTLRNINPDVLFEVHNYNITTVENFQHFMDRISNGGLEEGKPVDLVLSCVDNFEARMTINTACNELGQTWMESGVSENAVSGHIQLIIPGESACFACAPPLVVAANIDEKTLKREGVCAASLPTTMGVVAGILVQNVLKFLLNFGTVSFYLGYNAMQDFFPTMSMKPNPQCDDRNCRKQQEEYKKKVAALPKQEVIQEEEEIIHEDNEWGIELVSEVSEEELKNFSGPVPDLPEGITVAYTIPKKQEDSVTELTVEDSGESLEDLMAKMKNM

SEQ ID NO: 69105 - protein, 404 aa, Homo sapiens
MAESVERLQQRVQELERELAQERSLQVPRSGDGGGGRVRIEKMSSEVVDSNPYSRLMALKRMGIVSDYEKIRTFAVAIVGVGGVGSVTAEMLTRCGIGKLLLFDYDKVELANMNRLFFQPHQAGLSKVQAAEHTLRNINPDVLFEVHNYNITTVENFQHFMDRISNGGLEEGKPVDLVLSCVDNFEARMTINTACNELGQTWMESGVSENAVSGHIQLIIPGESACFACAPPLVVAANIDEKTLKREGVCAASLPTTMGVVAGILVQNVLKFLLNFGTVSFYLGYNAMQDFFPTMSMKPNPQCDDRNCRKQQEEYKKKVAALPKQEVIQEEEEIIHEDNEWGIELVSEVSEEELKNFSGPVPDLPEGITVAYTIPKKQEDSVTELTVEDSGESLEDLMAKMKNM

SEQ ID NO: 69106 - protein, 792 aa, Homo sapiens
MWIQVRTMDGRQTHTVDSLSRLTKVEELRRKIQELFHVEPGLQRLFYRGKQMEDGHTLFDYEVRLNDTIQLLVRQSLVLPHSTKERDSELSDTDSGCCLGQSESDKSSTHGEAAAETDSRPADEDMWDETELGLYKVNEYVDARDTNMGAWFEAQVVRVTRKAPSRDEPCSSTSRPALEEDVIYHVKYDDYPENGVVQMNSRDVRARARTIIKWQDLEVGQVVMLNYNPDNPKERGFWYDAEISRKRETRTARELYANVVLGDDSLNDCRIIFVDEVFKIERPGEGSPMVDNPMRRKSGPSCKHCKDDVNRLCRVCACHLCGGRQDPDKQLMCDECDMAFHIYCLDPPLSSVPSEDEWYCPECRNDASEVVLAGERLRESKKKAKMASATSSSQRDWGKGMACVGRTKECTIVPSNHYGPIPGIPVGTMWRFRVQVSESGVHRPHVAGIHGRSNDGAYSLVLAGGYEDDVDHGNFFTYTGSGGRDLSGNKRTAEQSCDQKLTNTNRALALNCFAPINDQEGAEAKDWRSGKPVRVVRNVKGGKNSKYAPAEGNRYDGIYKVVKYWPEKGKSGFLVWRYLLRRDDDEPGPWTKEGKDRIKKLGLTMQYPEGYLEALANREREKENSKREEEEQQEGGFASPRTGKGKWKRKSAGGGPSRAGPRRTSKKTKVEPYSLTAQQSSLIREDKSNAKLWNEVLASLKDRPASGSPFQLFLSKVEETFQCICCQELVFRPITTVCQHNVCKDCLDRSFRAQVFSCPACRYDLGRSYAMQVNQPLQTVLNQLFPGYGNGR

SEQ ID NO: 69107 - protein, 407 aa, Homo sapiens
MASATSSSQRDWGKGMACVGRTKECTIVPSNHYGPIPGIPVGTMWRFRVQVSESGVHRPHVAGIHGRSNDGAYSLVLAGGYEDDVDHGNFFTYTGSGGRDLSGNKRTAEQSCDQKLTNTNRALALNCFAPINDQEGAEAKDWRSGKPVRVVRNVKGGKNSKYAPAEGNRYDGIYKVVKYWPEKGKSGFLVWRYLLRRDDDEPGPWTKEGKDRIKKLGLTMQYPEGYLEALANREREKENSKREEEEQQEGGFASPRTGKGKWKRKSAGGGPSRAGPRRTSKKTKVEPYSLTAQQSSLIREDKSNAKLWNEVLASLKDRPASGSPFQLFLSKVEETFQCICCQELVFRPITTVCQHNVCKDCLDRSFRAQVFSCPACRYDLGRSYAMQVNQPLQTVLNQLFPGYGNGR

SEQ ID NO: 69108 - protein, 805 aa, Homo sapiens
MGVFAVPPLSADTMWIQVRTMDGRQTHTVDSLSRLTKVEELRRKIQELFHVEPGLQRLFYRGKQMEDGHTLFDYEVRLNDTIQLLVRQSLVLPHSTKERDSELSDTDSGCCLGQSESDKSSTHGEAAAETDSRPADEDMWDETELGLYKVNEYVDARDTNMGAWFEAQVVRVTRKAPSRDEPCSSTSRPALEEDVIYHVKYDDYPENGVVQMNSRDVRARARTIIKWQDLEVGQVVMLNYNPDNPKERGFWYDAEISRKRETRTARELYANVVLGDDSLNDCRIIFVDEVFKIERPGEGSPMVDNPMRRKSGPSCKHCKDDVNRLCRVCACHLCGGRQDPDKQLMCDECDMAFHIYCLDPPLSSVPSEDEWYCPECRNDASEVVLAGERLRESKKKAKMASATSSSQRDWGKGMACVGRTKECTIVPSNHYGPIPGIPVGTMWRFRVQVSESGVHRPHVAGIHGRSNDGAYSLVLAGGYEDDVDHGNFFTYTGSGGRDLSGNKRTAEQSCDQKLTNTNRALALNCFAPINDQEGAEAKDWRSGKPVRVVRNVKGGKNSKYAPAEGNRYDGIYKVVKYWPEKGKSGFLVWRYLLRRDDDEPGPWTKEGKDRIKKLGLTMQYPEGYLEALANREREKENSKREEEEQQEGGFASPRTGKGKWKRKSAGGGPSRAGPRRTSKKTKVEPYSLTAQQSSLIREDKSNAKLWNEVLASLKDRPASGSPFQLFLSKVEETFQCICCQELVFRPITTVCQHNVCKDCLDRSFRAQVFSCPACRYDLGRSYAMQVNQPLQTVLNQLFPGYGNGR

SEQ ID NO: 69109 - protein, 792 aa, Homo sapiens; identical to SEQ ID NO: 69106

SEQ ID NO: 69110 - protein, 792 aa, Homo sapiens; identical to SEQ ID NO: 69106

SEQ ID NO: 69111 - protein, 1079 aa, Homo sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLRAGMQWCDLSSLQPPPPGFKRFSHLSLPNSWNYRHLPSCPTNFCIFVETGFHHVGQACLELLTSGGLLASASQSAGITGVSHHAR

SEQ ID NO: 69112 - protein, 1347 aa, Homo sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 69113 - protein, 1240 aa, Homo sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIK

SEQ ID NO: 69114 - protein, 207 aa, Homo sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAESKYF

SEQ ID NO: 69115 - protein, 1392 aa, Homo sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 69116 - protein, 1211 aa, Homo sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQNGSDNWNGGQSLSHHPVQQVYSLCLTPQKLQHLEQLRANRDNLNPAQKHQLEQLESQFVLMQQMRHKEVAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEALSLSSSS

SEQ ID NO: 69117 - protein, 1046 aa, Homo sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGSVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLRAGMQWCDLSSLQPPPPGFKRFSHLSLPNSWNYRHLPSCPTNFCIFVETGFHHVGQACLELLTSGGLLASASQSAGITGVSHHAR

SEQ ID NO: 69118 - protein, 1005 aa, Homo sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGSVLYQQQNQPMDALQAYICAVQLDHGHAAAWMDLGTLYESCNQPQDAIKCYLNAARSKRCSNTSTLAARIKFLQQSLSLHMITSSQVEGLSSPAKKKRTSSPTKNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLRSLILSHPGWNAMV

SEQ ID NO: 69119 - protein, 1070 aa, Homo sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQQSLSLHMITSSQVEGLSSPAKKKRTSSPTKNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLR

SEQ ID NO: 69120 - protein, 265 aa, Homo sapiens
MPNMVFIGGINCKKRKDLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 69121 - protein, 534 aa, Homo sapiens
MATGLQVPLPQLATGLLLLLSVQPWAESGKVLVVPTDGSHWLSMREALRDLHARGHQVVVLTLEVNMYIKEENFFTLTTYAISWTQDEFDRLLLGHTQSFFETEHLLMKFSRRMAIMNNMSLIIHRSCVELLHNEALIRHLHATSFDVVLTDPFHLCAAVLAKYLSIPAVFFLRNIPCDLDFKGTQCPNPSSYIPRLLTTNSDHMTFLQRVKNMLYPLALSYLCHAVSAPYASLASELFQREVSVVDLVSHASVWLFRGDFVMDYPRPIMPNMVFIGGINCANGKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 69122 - protein, 532 aa, Homo sapiens
MACLLRSFQRISAGVFFLALWGMVVGDKLLVVPQDGSHWLSMKDIVEVLSDRGHEIVVVVPEVNLLLKESKYYTRKIYPVPYDQEELKNRYQSFGNNHFAERSFLTAPQTEYRNNMIVIGLYFINCQSLLQDRDTLNFFKESKFDALFTDPALPCGVILAEYLGLPSVYLFRGFPCSLEHTFSRSPDPVSYIPRCYTKFSDHMTFSQRVANFLVNLLEPYLFYCLFSKYEELASAVLKRDVDIITLYQKVSVWLLRYDFVLEYPRPVMPNMVFIGGINCKKRKDLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 69123 - protein, 189 aa, Homo sapiens
MACLLRSFQRISAGVFFLALWGMVVGDKLLVVPQDGSHWLSMKDIVEVLSDRGHEIVVVVPEVNLLLKESKYYTRKIYPVPYDQEELKNRYQSFGNNHFAERSFLTAPQTEYRNNMIVIGLYFINCQSLLQDRDTLNFFKESKFDALFTDPALPCGVILAEYLGLPSVYLFRGFPCSLEHTFSRSPDPV

SEQ ID NO: 69124 - protein, 530 aa, Homo sapiens
MARAGWTGLLPLYVCLLLTCGFAKAGKLLVVPMDGSHWFTMQSVVEKLILRGHEVVVVMPEVSWQLGRSLNCTVKTYSTSYTLEDQDREFMVFADARWTAPLRSAFSLLTSSSNGIFDLFFSNCRSLFNDRKLVEYLKESCFDAVFLDPFDACGLIVAKYFSLPSVVFARGIFCHYLEEGAQCPAPLSYVPRLLLGFSDAMTFKERVWNHIMHLEEHLFCPYFFKNVLEIASEILQTPVTAYDLYSHTSIWLLRTDFVLEYPKPVMPNMIFIGGINCHQGKPVPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 69125 - protein, 530 aa, Homo sapiens
MARTGWTSPIPLCVSLLLTCGFAEAGKLLVVPMDGSHWFTMQSVVEKLILRGHEVVVVMPEVSWQLGKSLNCTVKTYSTSYTLEDLDREFMDFADAQWKAQVRSLFSLFLSSSNGFFNLFFSHCRSLFNDRKLVEYLKESSFDAVFLDPFDACGLIVAKYFSLPSVVFARGIACHYLEEGAQCPAPLSYVPRILLGFSDAMTFKERVRNHIMHLEEHLFCQYFSKNALEIASEILQTPVTAYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 69126 - protein, 530 aa, Homo sapiens
MACTGWTSPLPLCVCLLLTCGFAEAGKLLVVPMDGSHWFTMRSVVEKLILRGHEVVVVMPEVSWQLGRSLNCTVKTYSTSYTLEDLDREFKAFAHAQWKAQVRSIYSLLMGSYNDIFDLFFSNCRSLFKDKKLVEYLKESSFDAVFLDPFDNCGLIVAKYFSLPSVVFARGILCHYLEEGAQCPAPLSYVPRILLGFSDAMTFKERVRNHIMHLEEHLLCHRFFKNALEIASEILQTPVTEYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 69127 - protein, 527 aa, Homo sapiens
MLNNLLLFSLQISLIGTTLGGNVLIWPMEGSHWLNVKIIIDELIKKEHNVTVLVASGALFITPTSNPSLTFEIYRVPFGKERIEGVIKDFVLTWLENRPSPSTIWRFYQEMAKVIKDFHMVSQEICDGVLKNQQLMAKLKKSKFEVLVSDPVFPCGDIVALKLGIPFMYSLRFSPASTVEKHCGKVPYPPSYVPAVLSELTDQMSFTDRIRNFISYHLQDYMFETLWKSWDSYYSKALGGLLLCCPGWSAVADLGSLQPLLPGFKRFSRLSLHCSWDYRLPAGRPTTLCETMGKAEIWLIRTYWDFEFPRPYLPNFEFVGGLHCKPAKPLPKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 69128 - protein, 693 aa, Homo sapiens
MLNNLLLFSLQISLIGTTLGGNVLIWPMEGSHWLNVKIIIDELIKKEHNVTVLVASGALFITPTSNPSLTFEIYRVPFGKERIEGVIKDFVLTWLENRPSPSTIWRFYQEMAKVIKDFHMVSQEICDGVLKNQQLMAKLKKSKFEVLVSDPVFPCGDIVALKLGIPFMYSLRFSPASTVEKHCGKVPYPPSYVPAVLSELTDQMSFTDRIRNFISYHLQDYMFETLWKSWDSYYSKALDGSHWLNIKIILEELIQRNHNVTVLASSATLFINSNPDSPVNFEVIPVSYKKSNIDSLIEHMIMLWIDHRPTPLTIWAFYKELGKLLDTFFQINIQLCDGVLKNPKLMARLQKGGFDVLVADPVTICGDLVALKLGIPFMYTLRFSPASTVERHCGKIPAPVSYVPAALSELTDQMTFGERIKNTISYSLQDYIFQSYWGEWNSYYSKILGRPTTLCETMGKAEIWLIRTYWDFEFPRPYLPNFEFVGGLHCKPAKPLPKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 69129 - protein, 536 aa, Homo sapiens
MVSIRDFTMPKKFVQMLVFNLTLTEVVLSGNVLIWPTDGSHWLNIKIILEELIQRNHNVTVLASSATLFINSNPDSPVNFEVIPVSYKKSNIDSLIEHMIMLWIDHRPTPLTIWAFYKELGKLLDTFFQINIQLCDGVLKNPKLMARLQKGGFDVLVADPVTICGDLVALKLGIPFMYTLRFSPASTVERHCGKIPAPVSYVPAALSELTDQMTFGERIKNTISYSLQDYIFQSYWGEWNSYYSKILGRPTTLCETMGKAEIWLIRTYWDFEFPRPYLPNFEFVGGLHCKPAKPLPKEMEEFIQSSGKNGVVVFSLGSMVKNLTEEKANLIASALAQIPQKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 69130 - protein, 527 aa, Homo sapiens
MLNNLLLFSLQISLIGTTLGGNVLIWPMEGSHWLNVKIIIDELIKKEHNVTVLVASGALFITPTSNPSLTFEIYRVPFGKERIEGVIKDFVLTWLENRPSPSTIWRFYQEMAKVIKDFHMVSQEICDGVLKNQQLMAKLKKSKFEVLVSDPVFPCGDIVALKLGIPFMYSLRFSPASTVEKHCGKVPYPPSYVPAVLSELTDQMSFTDRIRNFISYHLQDYMFETLWKSWDSYYSKALGRPTTLCETMGKAEIWLIRTYWDFEFPRPYLPNFEFVGGLHCKPAKPLPKEMEEFIQSSGKNGVVVFSLGSMVKNLTEEKANLIASALAQIPQKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 69131 - protein, 158 aa, Homo sapiens
MLNNLLLFSLQISLIGTTLGGNVLIWPMEGSHWLNVKIIIDELIKKEHNVTVLVASGALFITPTSNPSLTFEIYRVPFGKERIEGVIKDFVLTWLENRPSPSTIWRFYQEMAKVIKDFHMVSQEICDGVLKNQQLMAKLKKSKFEVLVSDPVFPCGDI

SEQ ID NO: 69132 - protein, 529 aa, Homo sapiens
MTLKWTSVLLLIHLSCYFSSGSCGKVLVWAAEYSHWMNMKTILKELVQRGHEVTVLASSASILFDPNDASTLKFEVYPTSLTKTEFENIIMQQVKRWSDIRKDSFWLYFSQEQEILWELYDIFRNFCKDVVSNKKVMKKLQESRFDIVFADAVFPCGELLAALLNIRFVYSLRFTPGYTIERHSGGLIFPPSYIPIVMSKLSDQMTFMERVKNMIYVLYFDFWFQMSDMKKWDQFYSEVLGRPTTLFETMGKADIWLMRNSWSFQFPHPFLPNVDFVGGFHCKPAKPLPKEMEEFVQSSGENGVVVFSLGSVISNMTAERANVIATALAKIPQKVLWRFDGNKPDALGLNTRLYKWIPQNDLLGHPKTRAFITHGGANGIYEAIYHGIPMVGIPLFFDQPDNIAHMKAKGAAVRLDFNTMSSTDLLNALKTVINDPLYKENIMKLSRIQHDQPVKPLDRAVFWIEFVMPHKGAKHLRVAAHDLTWFQYHSLDVIGFLLACVATVIFIITKFCLFCFWKFARKGKKGKRD

SEQ ID NO: 69133 - protein, 530 aa, Homo sapiens
MSLKWTSVFLLIQLSCYFSSGSCGKVLVWPTEYSHWINMKTILEELVQRGHEVTVLTSSASTLVNASKSSAIKLEVYPTSLTKNYLEDSLLKILDRWIYGVSKNTFWSYFSQLQELCWEYYDYSNKLCKDAVLNKKLMMKLQESKFDVILADALNPCGELLAELFNIPFLYSLRFSVGYTFEKNGGGFLFPPSYVPVVMSELSDQMIFMERIKNMIHMLYFDFWFQIYDLKKWDQFYSEVLGRPTTLFETMGKAEMWLIRTYWDFEFPRPFLPNVDFVGGLHCKPAKPLPKEMEEFVQSSGENGIVVFSLGSMISNMSEESANMIASALAQIPQKVLWRFDGKKPNTLGSNTRLYKWLPQNDLLGHPKTKAFITHGGTNGIYEAIYHGIPMVGIPLFADQHDNIAHMKAKGAALSVDIRTMSSRDLLNALKSVINDPVYKENVMKLSRIHHDQPMKPLDRAVFWIEFVMRHKGAKHLRVAAHNLTWIQYHSLDVIAFLLACVATVIFIITKFCLFCFRKLAKKGKKKKRD

SEQ ID NO: 69134 - protein, 530 aa, Homo sapiens
MSLKWMSVFLLMQLSCYFSSGSCGKVLVWPTEYSHWINMKTILEELVQRGHEVIVLTSSASILVNASKSSAIKLEVYPTSLTKNDLEDFFMKMFDRWTYSISKNTFWSYFSQLQELCWEYSDYNIKLCEDAVLNKKLMRKLQESKFDVLLADAVNPCGELLAELLNIPFLYSLRFSVGYTVEKNGGGFLFPPSYVPVVMSELSDQMIFMERIKNMIYMLYFDFWFQAYDLKKWDQFYSEVLGRPTTLFETMGKAEMWLIRTYWDFEFPRPFLPNVDFVGGLHCKPAKPLPKEMEEFVQSSGENGIVVFSLGSMISNMSEESANMIASALAQIPQKVLWRFDGKKPNTLGSNTRLYKWLPQNDLLGHPKTKAFITHGGTNGIYEAIYHGIPMVGIPLFADQHDNIAHMKAKGAALSVDIRTMSSRDLLNALKSVINDPIYKENIMKLSRIHHDQPVKPLDRAVFWIEFVMRHKGAKHLRVAAHNLTWIQYHSLDVIAFLLACVATMIFMITKCCLFCFRKLAKTGKKKKRD

SEQ ID NO: 69135 - protein, 529 aa, Homo sapiens
MALKWTSVLLLIHLGCYFSSGSCGKVLVWTGEYSHWMNMKTILKELVQRGHEVTVLASSASILFDPNDAFTLKLEVYPTSLTKTEFENIIMQQVKRWSDIQKDSFWLYFSQEQEILWEFHDIFRNFCKDVVSNKKVMKKLQESRFDIIFADAFFPCGELLAALLNIPFVYSLCFTPGYTIERHSGGLIFPPSYIPVVMSKLSDQMTFMERVKNMIYVLYFDFWFQMCDMKKWDQFYSEVLGRPTTLFETMGKADIWLMRNSWSFQFPHPFLPNIDFVGGLHCKPAKPLPKEMEEFVQSSGENGVVVFSLGSVISNMTAERANVIATALAKIPQKVLWRFDGNKPDALGLNTRLYKWIPQNDLLGLPKTRAFITHGGANGIYEAIYHGIPMVGIPLFWDQPDNIAHMKAKGAAVRLDFHTMSSTDLLNALKTVINDPSYKENVMKLSIIQHDQPVKPLHRAVFWIEFVMCHKGAKHLRVAARDLTWFQYHSLDVIGFLLACVATVIFVVTKFCLFCFWKFARKGKKGKRD

SEQ ID NO: 69136 - protein, 335 aa, Homo sapiens
MALKWTSVLLLIHLGCYFSSGSCGKVLVWTGEYSHWMNMKTILKELVQRGHEVTVLASSASILFDPNDAFTLKLEVYPTSLTKTEFENIIMQQVKRWSDIQKDSFWLYFSQEQEILWEFHDIFRNFCKDVVSNKKVMKKLQESRFDIIFADAFFPCGELLAALLNIPFVYSLCFTPGYTIERHSGGLIFPPSYIPVVMSKLSDQMTFMERVKNMIYVLYFDFWFQMCDMKKWDQFYSEVLGRPTTLFETMGKADIWLMRNSWSFQFPHPFLPNIDFVGGLHCKPAKPLPKEMEEFVQSSGENGVVVFSLGSVISNMTAERANVIATALAKIPQKI

SEQ ID NO: 69137 - protein, 528 aa, Homo sapiens
MSMKWTSALLLIQLSCYFSSGSCGKVLVWPTEFSHWMNIKTILDELVQRGHEVTVLASSASISFDPNSPSTLKFEVYPVSLTKTEFEDIIKQLVKRWAELPKDTFWSYFSQVQEIMWTFNDILRKFCKDIVSNKKLMKKLQESRFDVVLADAVFPFGELLAELLKIPFVYSLRFSPGYAIEKHSGGLLFPPSYVPVVMSELSDQMTFIERVKNMIYVLYFEFWFQIFDMKKWDQFYSEVLGRPTTLSETMAKADIWLIRNYWDFQFPHPLLPNVEFVGGLHCKPAKPLPKEMEEFVQSSGENGVVVFSLGSMVSNTSEERANVIASALAKIPQKVLWRFDGNKPDTLGLNTRLYKWIPQNDLLGHPKTRAFITHGGANGIYEAIYHGIPMVGVPLFADQPDNIAHMKAKGAAVSLDFHTMSSTDLLNALKTVINDPLYKENAMKLSRIHHDQPVKPLDRAVFWIEFVMRHKGAKHLRVAAHDLTWFQYHSLDVTGFLLACVATVIFIITKCLFCVWKFVRTGKKGKRD

SEQ ID NO: 69138 - protein, 392 aa, Homo sapiens
MFFALLHVSSTNGLDAVFPFGELLAELLKIPFVYSLRFSPGYAIEKHSGGLLFPPSYVPVVMSELSDQMTFIERVKNMIYVLYFEFWFQIFDMKKWDQFYSEVLGRPTTLSETMAKADIWLIRNYWDFQFPHPLLPNVEFVGGLHCKPAKPLPKEMEEFVQSSGENGVVVFSLGSMVSNTSEERANVIASALAKIPQKVLWRFDGNKPDTLGLNTRLYKWIPQNDLLGHPKTRAFITHGGANGIYEAIYHGIPMVGVPLFADQPDNIAHMKAKGAAVSLDFHTMSSTDLLNALKTVINDPLYKENAMKLSRIHHDQPVKPLDRAVFWIEFVMRHKGAKHLRVAAHDLTWFQYHSLDVTGFLLACVATVIFIITKCLFCVWKFVRTGKKGKRD

SEQ ID NO: 69139 - protein, 54 aa, Homo sapiens
MSMKWTSALLLIQLSCYFSSGSCGKVLVWPTEFSHWMNIKTILDELVQRGHEVT

SEQ ID NO: 69140 - protein, 529 aa, Homo sapiens
MSVKWTSVILLIQLSFCFSSGNCGKVLVWAAEYSHWMNIKTILDELIQRGHEVTVLASSASILFDPNNSSALKIEIYPTSLTKTELENFIMQQIKRWSDLPKDTFWLYFSQVQEIMSIFGDITRKFCKDVVSNKKFMKKVQESRFDVIFADAIFPCSELLAELFNIPFVYSLSFSPGYTFEKHSGGFIFPPSYVPVVMSELTDQMTFMERVKNMIYVLYFDFWFEIFDMKKWDQFYSEVLGRPTTLSETMGKADVWLIRNSWNFQFPYPLLPNVDFVGGLHCKPAKPLPKEMEDFVQSSGENGVVVFSLGSMVSNMTEERANVIASALAQIPQKVLWRFDGNKPDTLGLNTRLYKWIPQNDLLGHPKTRAFITHGGANGIYEAIYHGIPMVGIPLFADQPDNIAHMKARGAAVRVDFNTMSSTDLLNALKRVINDPSYKENVMKLSRIQHDQPVKPLDRAVFWIEFVMRHKGAKHLRVAAHDLTWFQYHSLDVIGFLLVCVATVIFIVTKCCLFCFWKFARKAKKGKND

SEQ ID NO: 69141 - protein, 422 aa, Homo sapiens
MLQWRRRHCCFAKMTWNAKRSLFRTHLIGVLSLVFLFAMFLFFNHHDWLPGRAGFKENPVTYTFRGFRSTKSETNHSSLRNIWKETVPQTLRPQTATNSNNTDLSPQGVTGLENTLSANGSIYNEKGTGHPNSYHFKYIINEPEKCQEKSPFLILLIAAEPGQIEARRAIRQTWGNESLAPGIQITRIFLLGLSIKLNGYLQRAILEESRQYHDIIQQEYLDTYYNLTIKTLMGMNWVATYCPHIPYVMKTDSDMFVNTEYLINKLLKPDLPPRHNYFTGYLMRGYAPNRNKDSKWYMPPDLYPSERYPVFCSGTGYVFSGDLAEKIFKVSLGIRRLHLEDVYVGICLAKLRIDPVPPPNEFVFNHWRVSYSSCKYSHLITSHQFQPSELIKYWNHLQQNKHNACANAAKEKAGRYRHRKLH

SEQ ID NO: 69142 - protein, 378 aa, Homo sapiens
MQLRLFRRLLLAALLLVIVWTLFGPSGLGEELLSLSLASLLPAPASPGPPLALPRLLIPNQEACSGPGAPPFLLILVCTAPENLNQRNAIRASWGGLREARGLRVQTLFLLGEPNAQHPVWGSQGSDLASESAAQGDILQAAFQDSYRNLTLKTLSGLNWAEKHCPMARYVLKTDDDVYVNVPELVSELVLRGGRWGQWERSTEPQREAEQEGGQVLHSEEVPLLYLGRVHWRVNPSRTPGGRHRVSEEQWPHTWGPFPPYASGTGYVLSASAVQLILKVASRAPLLPLEDVFVGVSARRGGLAPTQCVKLAGATHYPLDRCCYGKFLLTSHRLDPWKMQEAWKLVGGSDGERTAPFCSWFQGVLGILRCRAIAWLQS

SEQ ID NO: 69143 - protein, 378 aa, Homo sapiens; identical to SEQ ID NO: 69142

SEQ ID NO: 69144 - protein, 378 aa, Homo sapiens; identical to SEQ ID NO: 69142

SEQ ID NO: 69145 - protein, 378 aa, Homo sapiens; identical to SEQ ID NO: 69142

SEQ ID NO: 69146 - protein, 378 aa, Homo sapiens; identical to SEQ ID NO: 69142

SEQ ID NO: 69147 - protein, 310 aa, Homo sapiens
MAFPKMRLMYICLLVLGALCLYFSMYSLNPFKEQSFVYKKDGNFLKLPDTDCRQTPPFLVLLVTSSHKQLAERMAIRQTWGKERMVKGKQLKTFFLLGTTSSAAETKEVDQESQRHGDIIQKDFLDVYYNLTLKTMMGIEWVHRFCPQAAFVMKTDSDMFINVDYLTELLLKKNRTTRFFTGFLKLNEFPIRQPFSKWFVSKSEYPWDRYPPFCSGTGYVFSGDVASQVYNVSKSVPYIKLEDVFVGLCLERLNIRLEELHSQPTFFPGGLRFSVCLFRRIVACHFIKPRTLLDYWQALENSRGEDCPPV

SEQ ID NO: 69148 - protein, 310 aa, Homo sapiens; identical to SEQ ID NO: 69147

SEQ ID NO: 69149 - protein, 310 aa, Homo sapiens; identical to SEQ ID NO: 69147

SEQ ID NO: 69150 - protein, 310 aa, Homo sapiens; identical to SEQ ID NO: 69147

SEQ ID NO: 69151 - protein, 398 aa, Homo sapiens
MRLREPLLSGSAAMPGASLQRACRLLVAVCALHLGVTLVYYLAGRDLSRLPQLVGVSTPLQGGSNSAAAIGQSSGELRTGGARPPPPLGASSQPRPGGDSSPVVDSGPGPASNLTSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQAGDTIFNRAKLLNVGFQEALKDYDYTCFVFSDVDLIPMNDHNAYRCFSQPRHISVAMDKFGFSLPYVQYFGGVSALSKQQFLTINGFPNNYWGWGGEDDDIFNRLVFRGMSISRPNAVVGRCRMIRHSRDKKNEPNPQRFDRIAHTKETMLSDGLNSLTYQVLDVQRYPLYTQITVDIGTPS

SEQ ID NO: 69152 - protein, 225 aa, Homo sapiens
MRLREPLLSGSAAMPGASLQRACRLLVAVCALHLGVTLVYYLAGRDLSRLPQLVGVSTPLQGGSNSAAAIGQSSGELRTGGARPPPPLGASSQPRPGGDSSPVVDSGPGPASNLTSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQYEKIRRLLW

SEQ ID NO: 69153 - protein, 355 aa, Homo sapiens
MRLREPLLSGSAAMPGASLQRACRLLVAVCALHLGVTLVYYLAGRDLSRLPQLVGVSTPVVDSGPGPASNLTSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQAGDTIFNRAKLLNVGFQEALKDYDYTCFVFSDVDLIPMNDHNAYRCFSQPRHISVAMDKFGFSLPYVQYFGGVSALSKQQFLTINGFPNNYWGWGGEDDDIFNRLVFRGMSISRPNAVVGRCRMIRHSRDKKNEPNPQRFDRIAHTKETMLSDGLNSLTYQVLDVQRYPLYTQITVDIGTPS

SEQ ID NO: 69154 - protein, 145 aa, Homo sapiens
MNDHNAYRCFSQPRHISVAMDKFGFSLPYVQYFGGVSALSKQQFLTINGFPNNYWGWGGEDDDIFNRLVFRGMSISRPNAVVGRCRMIRHSRDKKNEPNPQRFDRIAHTKETMLSDGLNSLTYQVLDVQRYPLYTQITVDIGTPS

SEQ ID NO: 69155 - protein, 401 aa, Homo sapiens
MAVEVQEQWPCLPAAGCPGPLGGPVAACGMSRLLGGTLERVCKAVLLLCLLHFLVAVILYFDVYAQHLAFFSRFSARGPAHALHPAASSSSSSSNCSRPNATASSSGLPEVPSALPGPTAPTLPPCPDSPPGLVGRLLIEFTSPMPLERVQRENPGVLMGGRYTPPDCTPAQTVAVIIPFRHREHHLRYWLHYLHPILRRQRLRYGVYVINQHGEDTFNRAKLLNVGFLEALKEDAAYDCFIFSDVDLVPMDDRNLYRCGDQPRHFAIAMDKFGFRLPYAGYFGGVSGLSKAQFLRINGFPNEYWGWGGEDDDIFNRISLTGMKISRPDIRIGRYRMIKHDRDKHNEPNPQRFTKIQNTKLTMKRDGIGSVRYQVLEVSRQPLFTNITVDIGRPPSWPPRG

SEQ ID NO: 69156 - protein, 372 aa, Homo sapiens
MSRLLGGTLERVCKAVLLLCLLHFLVAVILYFDVYAQHLAFFSRFSARGPAHALHPAASSSSSSSNCSRPNATASSSGLPEVPSALPGPTAPTLPPCPDSPPGLVGRLLIEFTSPMPLERVQRENPGVLMGGRYTPPDCTPAQTVAVIIPFRHREHHLRYWLHYLHPILRRQRLRYGVYVINQHGEDTFNRAKLLNVGFLEALKEDAAYDCFIFSDVDLVPMDDRNLYRCGDQPRHFAIAMDKFGFRLPYAGYFGGVSGLSKAQFLRINGFPNEYWGWGGEDDDIFNRISLTGMKISRPDIRIGRYRMIKHDRDKHNEPNPQRFTKIQNTKLTMKRDGIGSVRYQVLEVSRQPLFTNITVDIGRPPSWPPRG

SEQ ID NO: 69157 - protein, 372 aa, Homo sapiens; identical to SEQ ID NO: 69156

SEQ ID NO: 69158 - protein, 306 aa, Homo sapiens
MPSTQLLAAAAAAATAPGPTPPPLAPGSLRSPVPCPVPRLPRCHPVLTRHLVLRVQRENPGVLMGGRYTPPDCTPAQTVAVIIPFRHREHHLRYWLHYLHPILRRQRLRYGVYVINQHGEDTFNRAKLLNVGFLEALKEDAAYDCFIFSDVDLVPMDDRNLYRCGDQPRHFAIAMDKFGFRLPYAGYFGGVSGLSKAQFLRINGFPNEYWGWGGEDDDIFNRISLTGMKISRPDIRIGRYRMIKHDRDKHNEPNPQRFTKIQNTKLTMKRDGIGSVRYQVLEVSRQPLFTNITVDIGRPPSWPPRG

SEQ ID NO: 69159 - protein, 146 aa, Homo sapiens
MLRRLLERPCTLALLVGSQLAVMMYLSLGGFRSLSALFGRDQGPTFDYSHPRDVYSNLSHLPGAPGGPPAPQGLPYCPERSPLLVGPVSVSFSPVPSLAEIVERNPRVEPGGRYRPPAALPPAPLLAAPAACLWHLCHPPGWKWNI

SEQ ID NO: 69160 - protein, 393 aa, Homo sapiens
MLRRLLERPCTLALLVGSQLAVMMYLSLGGFRSLSALFGRDQGPTFDYSHPRDVYSNLSHLPGAPGGPPAPQGLPYCPERSPLLVGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTALRGSH

SEQ ID NO: 69161 - protein, 393 aa, Homo sapiens
MLRRLLERPCTLALLVGSQLAVMMYLSLGGFRSLSALFGRDQGPTFDYSHPRDVYSNLSHLPGAPGGPPAPQGLPYCPERSPLLVGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTPSEVHT

SEQ ID NO: 69162 - protein, 393 aa, Homo sapiens; identical to SEQ ID NO: 69160

SEQ ID NO: 69163 - protein, 370 aa, Homo sapiens
MLRRLLERPCTLALFGRDQGPTFDYSHPRDVYSNLSHLPGAPGGPPAPQGLPYCPERSPLLVGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTALRGSH

SEQ ID NO: 69164 - protein, 227 aa, Homo sapiens
MLRRLLERPCTLALLVGSQLAVMMYLSLGGFRSLSALFGRDQGPTFDYSHPRDVYSNLSHLPGAPGGPPAPQGLPYCPERSPLLVGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYR

SEQ ID NO: 69165 - protein, 344 aa, Homo sapiens
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKHLMYLLEHLHPFLQRQQLDYGIYVIHQAEGKKFNRAKLLNVGYLEALKEENWDCFIFHDVDLVPENDFNLYKCEEHPKHLVVGRNSTGYRLRYSGYFGGVTALSREQFFKVNGFSNNYWGWGGEDDDLRLRVELQRMKISRPLPEVGKYTMVFHTRDKGNEVNAERMKLLHQVSRVWRTDGLSSCSYKLVSVEHNPLYINITVDFWFGA

SEQ ID NO: 69166 - protein, 344 aa, Homo sapiens; identical to SEQ ID NO: 69165

SEQ ID NO: 69167 - protein, 6 aa, Homo sapiens
MGFNLT

SEQ ID NO: 69168 - protein, 2 aa, Homo sapiens
MG

SEQ ID NO: 69169 - protein, 55 aa, Homo sapiens
MGFNLTFHLSYKFRLLLLLTLCLTVVGWATSNYFVGAIQEIPKAKEFMANFHKTL

SEQ ID NO: 69170 - protein, 21 aa, Homo sapiens
MGFNLTFHLSYKFRLLLLLTL

SEQ ID NO: 69171 - protein, 136 aa, Homo sapiens
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKH

SEQ ID NO: 69172 - protein, 118 aa, Homo sapiens
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQEC

SEQ ID NO: 69173 - protein, 344 aa, Homo sapiens; identical to SEQ ID NO: 69165

SEQ ID NO: 69174 - protein, 42 aa, Homo sapiens
MGFNLTFHLSYKFRLLLLLTLCLTVVGWATSNYFVGAIQEIP

SEQ ID NO: 69175 - protein, 388 aa, Homo sapiens
MRARRGLLRLPRRSLLAALFFFSLSSSLLYFVYVAPGIVNTYLFMMQAQGILIRDNVRTIGAQVYEQVLRSAYAKRNSSVNDSDYPLDLNHSETFLQTTTFLPEDFTYFANHTCPERLPSMKGPIDINMSEIGMDYIHELFSKDPTIKLGGHWKPSDCMPRWKVAILIPFRNRHEHLPVLFRHLLPMLQRQRLQFAFYVVEQVGTQPFNRAMLFNVGFQEAMKDLDWDCLIFHDVDHIPESDRNYYGCGQMPRHFATKLDKYMYLLPYTEFFGGVSGLTVEQFRKINGFPNAFWGWGGEDDDLWNRVQNAGYSVSRPEGDTGKYKSIPHHHRGEVQFLGRYALLRKSKERQGLDGLNNLNYFANITYDALYKNITVNLTPELAQVNEY

SEQ ID NO: 69176 - protein, 343 aa, Homo sapiens
MSVLRRMMRVSNRSLLAFIFFFSLSSSCLYFIYVAPGIDYPEGNNSSDYLVQTTTYLPENFTYSPYLPCPEKLPYMRGFLNVNVSEVSFDEIHQLFSKDLDIEPGGHWRPKDCKPRWKVAVLIPFRNRHEHLPIFFLHLIPMLQKQRLEFAFYVIEQTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 69177 - protein, 382 aa, Homo sapiens
MSVLRRMMRVSNRSLLAFIFFFSLSSSCLYFIYVAPGIANTYLFMVQARGIMLRENVKTIGHMIRLYTNKNSTLNGTDYPEGNNSSDYLVQTTTYLPENFTYSPYLPCPEKLPYMRGFLNVNVSEVSFDEIHQLFSKDLDIEPGGHWRPKDCKPRWKVAVLIPFRNRHEHLPIFFLHLIPMLQKQRLEFAFYVIEQTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 69178 - protein, 343 aa, Homo sapiens
MSVLRRMMRVSNRSLLAFIFFFSLSSSCLYFIYVAPGIANTYLFMVQARGIMLRENVKTIGHMIRLYTNKNSTLNGTDYPEGNNSSDYLVQTTTYLPENFTYSPYLPCPEKLPYMRGFLNVNVSEVSFDEIHQLFSKDLDIEPGGHWRPKDCKPRWKTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 69179 - protein, 348 aa, Homo sapiens
MAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRIYNLGTGTGYSVLQMVQAMEKASGKKIPYKVVARREGDVAACYANPSLAQEELGWTAALGLDRMCEDLWRWQKQNPSGFGTQA

SEQ ID NO: 69180 - protein, 258 aa, Homo sapiens
MDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRIPYKVVARREGDVAACYANPSLAQEELGWTAALGLDRMCEDLWRWQKQNPSGFGTQA

SEQ ID NO: 69181 - protein, 227 aa, Homo sapiens
MDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRIYNLGTGTGYSVLQMVQAMEKASGKK

SEQ ID NO: 69182 - protein, 195 aa, Homo sapiens
MAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASG

SEQ ID NO: 69183 - protein, 239 aa, Homo sapiens
MDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRIPYKVVARREGDVAACYANPSLAQEELGWTAALGLDRM

SEQ ID NO: 69184 - protein, 194 aa, Homo sapiens
MAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHAS

SEQ ID NO: 69185 - protein, 108 aa, Homo sapiens
VAIGRREALNVFGNDYDTEDGTGVRDYIHVVDLAKGHIAALRKLKEQCGCRIPYKVVARREGDVAACYANPSLAQEELGWTAALGLDRMCEDLWRWQKQNPSGFGTQA

SEQ ID NO: 69186 - protein, 372 aa, Homo sapiens
MKYLRHRRPNATLILAIGAFTLLLFSLLVSPPTCKVQEQPPAIPEALAWPTPPTRPAPAPCHANTSMVTHPDFATQPQHVQNFLLYRHCRHFPLLQDVPPSKCAQPVFLLLVIKSSPSNYVRRELLRRTWGRERKVRGLQLRLLFLVGTASNPHEARKVNRLLELEAQTHGDILQWDFHDSFFNLTLKQVLFLQWQETRCANASFVLNGDDDVFAHTDNMVFYLQDHDPGRHLFVGQLIQNVGPIRAFWSKYYVPEVVTQNERYPPYCGGGGFLLSRFTAAALRRAAHVLDIFPIDDVFLGMCLELEGLKPASHSGIRTSGVRAPSQRLSSFDPCFYRDLLLVHRFLPYEMLLMWDALNQPNLTCGNQTQIY

SEQ ID NO: 69187 - protein, 378 aa, Homo sapiens
MLPPQPSAAHQGRGGRSGLLPKGPAMLCRLCWLVSYSLAVLLLGCLLFLRKAAKPAGDPTAHQPFWAPPTPRHSRCPPNHTVSSASLSLPSRHRLFLTYRHCRNFSILLEPSGCSKDTFLLLAIKSQPGHVERRAAIRSTWGRVGGWARGRQLKLVFLLGVAGSAPPAQLLAYESREFDDILQWDFTEDFFNLTLKELHLQRWVVAACPQAHFMLKGDDDVFVHVPNVLEFLDGWDPAQDLLVGDVIRQALPNRNTKVKYFIPPSMYRATHYPPYAGGGGYVMSRATVRRLQAIMEDAELFPIDDVFVGMCLRRLGLSPMHHAGFKTFGIRRPLDPLDPCLYRGLLLVHRLSPLEMWTMWALVTDEGLKCAAGPIPQR

SEQ ID NO: 69188 - protein, 353 aa, Homo sapiens
MLCRLCWLVSYSLAVLLLGCLLFLRKAAKPAGDPTAHQPFWAPPTPRHSRCPPNHTVSSASLSLPSRHRLFLTYRHCRNFSILLEPSGCSKDTFLLLAIKSQPGHVERRAAIRSTWGRVGGWARGRQLKLVFLLGVAGSAPPAQLLAYESREFDDILQWDFTEDFFNLTLKELHLQRWVVAACPQAHFMLKGDDDVFVHVPNVLEFLDGWDPAQDLLVGDVIRQALPNRNTKVKYFIPPSMYRATHYPPYAGGGGYVMSRATVRRLQAIMEDAELFPIDDVFVGMCLRRLGLSPMHHAGFKTFGIRRPLDPLDPCLYRGLLLVHRLSPLEMWTMWALVTDEGLKCAAGPIPQR

SEQ ID NO: 69189 - protein, 353 aa, Homo sapiens; identical to SEQ ID NO: 69188

SEQ ID NO: 69190 - protein, 494 aa, Homo sapiens
MFEIKKICCIGAGYVGGPTCSVIAHMCPEIRVTVVDVNESRINAWNSPTLPIYEPGLKEVVESCRGKNLFFSTNIDDAIKEADLVFISVNTPTKTYGMGKGRAADLKYIEACARRIVQNSNGYKIVTEKSTVPVRAAESIRRIFDANTKPNLNLQVLSNPEFLAEGTAIKDLKNPDRVLIGGDETPEGQRAVQALCAVYEHWVPREKILTTNTWSSELSKLAANAFLAQRISSINSISALCEATGADVEEVATAIGMDQRIGNKFLKASVGFGGSCFQKDVLNLVYLCEALNLPEVARYWQQVIDMNDYQRRRFASRIIDSLFNTVTDKKIAILGFAFKKDTGDTRESSSIYISKYLMDEGAHLHIYDPKVPREQIVVDLSHPGVSEDDQVSRLVTISKDPYEACDGAHAVVICTEWDMFKELDYERIHKKMLKPAFIFDGRRVLDGLHNELQTIGFQIETIGKKVSSKRIPYAPSGEIPKFSLQDPPNKKPKV

SEQ ID NO: 69191 - protein, 427 aa, Homo sapiens
MFEIKKICCIGAGYVGGPTCSVIAHMCPEIRVTVVDVNESRINAWNSPTLPIYEPGLKEVVESCRGKNLFFSTNIDDAIKEADLVFISVLSNPEFLAEGTAIKDLKNPDRVLIGGDETPEGQRAVQALCAVYEHWVPREKILTTNTWSSELSKLAANAFLAQRISSINSISALCEATGADVEEVATAIGMDQRIGNKFLKASVGFGGSCFQKDVLNLVYLCEALNLPEVARYWQQVIDMNDYQRRRFASRIIDSLFNTVTDKKIAILGFAFKKDTGDTRESSSIYISKYLMDEGAHLHIYDPKVPREQIVVDLSHPGVSEDDQVSRLVTISKDPYEACDGAHAVVICTEWDMFKELDYERIHKKMLKPAFIFDGRRVLDGLHNELQTIGFQIETIGKKVSSKRIPYAPSGEIPKFSLQDPPNKKPKV

SEQ ID NO: 69192 - protein, 55 aa, Homo sapiens
MFEIKKICCIGAGYVGGPTCSVIAHMCPEIRVTVVDVNESRINAWNSPTLPIYED

SEQ ID NO: 69193 - protein, 85 aa, Homo sapiens
MFEIKKICCIGAGYVGGPTCSVIAHMCPEIRVTVVDVNESRINAWNSPTLPIYEPGLKEVVESCRGKNLFFSTNIDDAIKEADLV

SEQ ID NO: 69194 - protein, 494 aa, Homo sapiens; identical to SEQ ID NO: 69190

SEQ ID NO: 69195 - protein, 397 aa, Homo sapiens
MGKGRAADLKYIEACARRIVQNSNGYKIVTEKSTVPVRAAESIRRIFDANTKPNLNLQVLSNPEFLAEGTAIKDLKNPDRVLIGGDETPEGQRAVQALCAVYEHWVPREKILTTNTWSSELSKLAANAFLAQRISSINSISALCEATGADVEEVATAIGMDQRIGNKFLKASVGFGGSCFQKDVLNLVYLCEALNLPEVARYWQQVIDMNDYQRRRFASRIIDSLFNTVTDKKIAILGFAFKKDTGDTRESSSIYISKYLMDEGAHLHIYDPKVPREQIVVDLSHPGVSEDDQVSRLVTISKDPYEACDGAHAVVICTEWDMFKELDYERIHKKMLKPAFIFDGRRVLDGLHNELQTIGFQIETIGKKVSSKRIPYAPSGEIPKFSLQDPPNKKPKV

SEQ ID NO: 69196 - protein, 130 aa, Homo sapiens
MFEIKKICCIGAGYVGGPTCSVIAHMCPEIRVTVVDVNESRINAWNSPTLPIYEPGLKEVVESCRGKNLFFSTNIDDAIKEADLVFISVNTPTKTYGMGKGRAADLKYIEACARRIVQNSNGYKIVTEKS

SEQ ID NO: 69197 - protein, 53 aa, Homo sapiens
MFEIKKICCIGAGYVGGPTCSVIAHMCPEIRVTVVDVNESRINAWNSPTLPIY

SEQ ID NO: 69198 - protein, 55 aa, Homo sapiens; identical to SEQ ID NO: 69192

SEQ ID NO: 69199 - protein, 153 aa, Homo sapiens
MFEIKKICCIGAGYVGGPTCSVIAHMCPEIRVTVVDVNESRINAWNSPTLPIYEPGLKEVVESCRGKNLFFSTNIDDAIKEADLVFISVNTPTKTYGMGKGRAADLKYIEACARRIVQNSNGYKIVTEKSTVPVRAAESIRRIFDANTKPNLN

SEQ ID NO: 69200 - protein, 181 aa, Homo sapiens
MWSSGLLIQDSTIMFEIKKICCIGAGYVGGPTCSVIAHMCPEIRVTVVDVNESRINAWNSPTLPIYEPGLKEVVESCRGKNLFFSTNIDDAIKEADLVFISVNTPTKTYGMGKGRAADLKYIEACARRIVQNSNGYKIVTEKSTVPVRAAESIRRIFDANTKPNLNLQVLSNPEFLAEGTA

SEQ ID NO: 69201 - protein, 394 aa, Homo sapiens
MALLDLALEGMAVFGFVLFLVLWLMHFMAIIYTRLHLNKKATDKQPYSKLPGVSLLKPLKGVDPNLINNLETFFELDYPKYEVLLCVQDHDDPAIDVCKKLLGKYPNVDARLFIGGKKVGINPKINNLMPGYEVAKYDLIWICDSGIRVIPDTLTDMVNQMTEKVGLVHGLPYVADRQGFAATLEQVYFGTSHPRYYISANVTGFKCVTGMSCLMRKDVLDQAGGLIAFAQYIAEDYFMAKAIADRGWRFAMSTQVAMQNSGSYSISQFQSRMIRWTKLRINMLPATIICEPISECFVASLIIGWAAHHVFRWDIMVFFMCHCLAWFIFDYIQLRGVQGGTLCFSKLDYAVAWFIRESMTIYIFLSALWDPTISWRTGRYRLRCGGTAEEILDV

SEQ ID NO: 69202 - protein, 1555 aa, Homo sapiens
MGCKGDASGACAAGALPVTGVCYKMGVLVVLTVLWLFSSVKADSKAITTSLTTKWFSTPLLLEASEFLAEDSQEKFWNFVEASQNIGSSDHDGTDYSYYHAILEAAFQFLSPLQQNLFKFCLSLRSYSATIQAFQQIAADEPPPEGCNSFFSVHGKKTCESDTLEALLLTASERPKPLLFKGDHRYPSSNPESPVVIFYSEIGSEEFSNFHRQLISKSNAGKINYVFRHYIFNPRKEPVYLSGYGVELAIKSTEYKAKDDTQVKGTEVNTTVIGENDPIDEVQGFLFGKLRDLHPDLEGQLKELRKHLVESTNEMAPLKVWQLQDLSFQTAARILASPVELALVVMKDLSQNFPTKARAITKTAVSSELRTEVEENQKYFKGTLGLQPGDSALFINGLHMDLDTQDIFSLFDVLRNEARVMEGLHRLGIEGLSLHNVLKLNIQPSEADYAVDIRSPAISWVNNLEVDSRYNSWPSSLQELLRPTFPGVIRQIRKNLHNMVFIVDPAHETTAELMNTAEMFLSNHIPLRIGFIFVVNDSEDVDGMQDAGVAVLRAYNYVAQEVDDYHAFQTLTHIYNKVRTGEKVKVEHVVSVLEKKYPYVEVNSILGIDSAYDRNRKEARGYYEQTGVGPLPVVLFNGMPFEREQLDPDELETITMHKILETTTFFQRAVYLGELPHDQDVVEYIMNQPNVVPRINSRILTAERDYLDLTASNNFFVDDYARFTILDSQGKTAAVANSMNYLTKKGMSSKEIYDDSFIRPVTFWIVGDFDSPSGRQLLYDAIKHQKSSNNVRISMINNPAKEISYENTQISRAIWAALQTQTSNAAKNFITKMAKEGAAEALAAGADIAEFSVGGMDFSLFKEVFESSKMDFILSHAVYCRDVLKLKKGQRAVISNGRIIGPLEDSELFNQDDFHLLENIILKTSGQKIKSHIQQLRVEEDVASDLVMKVDALLSAQPKGDPRIEYQFFEDRHSAIKLRPKEGETYFDVVAVVDPVTREAQRLAPLLLVLAQLINMNLRVFMNCQSKLSDMPLKSFYRYVLEPEISFTSDNSFAKGPIAKFLDMPQSPLFTLNLNTPESWMVESVRTPYDLDNIYLEEVDSVVAAEYELEYLLLEGHCYDITTGQPPRGLQFTLGTSANPVIVDTIVMANLGYFQLKANPGAWILRLRKGRSEDIYRIYSHDGTDSPPDADEVVIVLNNFKSKIIKVKVQKKADMVNEDLLSDGTSENESGFWDSFKWGFTGQKTEEVKQDKDDIINIFSVASGHLYERFLRIMMLSVLKNTKTPVKFWFLKNYLSPTFKEFIPYMANEYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAVRIVPEWQDYDQEIKQLQIRFQKEKETGALYKEKTKEPSREGPQKREEL

SEQ ID NO: 69203 - protein, 1531 aa, Homo sapiens
MGVLVVLTVLWLFSSVKADSKAITTSLTTKWFSTPLLLEASEFLAEDSQEKFWNFVEASQNIGSSDHDGTDYSYYHAILEAAFQFLSPLQQNLFKFCLSLRSYSATIQAFQQIAADEPPPEGCNSFFSVHGKKTCESDTLEALLLTASERPKPLLFKGDHRYPSSNPESPVVIFYSEIGSEEFSNFHRQLISKSNAGKINYVFRHYIFNPRKEPVYLSGYGVELAIKSTEYKAKDDTQVKGTEVNTTVIGENDPIDEVQGFLFGKLRDLHPDLEGQLKELRKHLVESTNEMAPLKVWQLQDLSFQTAARILASPVELALVVMKDLSQNFPTKARAITKTAVSSELRTEVEENQKYFKGTLGLQPGDSALFINGLHMDLDTQDIFSLFDVLRNEARVMEGLHRLGIEGLSLHNVLKLNIQPSEADYAVDIRSPAISWVNNLEVDSRYNSWPSSLQELLRPTFPGVIRQIRKNLHNMVFIVDPAHETTAELMNTAEMFLSNHIPLRIGFIFVVNDSEDVDGMQDAGVAVLRAYNYVAQEVDDYHAFQTLTHIYNKVRTGEKVKVEHVVSVLEKKYPYVEVNSILGIDSAYDRNRKEARGYYEQTGVGPLPVVLFNGMPFEREQLDPDELETITMHKILETTTFFQRAVYLGELPHDQDVVEYIMNQPNVVPRINSRILTAERDYLDLTASNNFFVDDYARFTILDSQGKTAAVANSMNYLTKKGMSSKEIYDDSFIRPVTFWIVGDFDSPSGRQLLYDAIKHQKSSNNVRISMINNPAKEISYENTQISRAIWAALQTQTSNAAKNFITKMAKEGAAEALAAGADIAEFSVGGMDFSLFKEVFESSKMDFILSHAVYCRDVLKLKKGQRAVISNGRIIGPLEDSELFNQDDFHLLENIILKTSGQKIKSHIQQLRVEEDVASDLVMKVDALLSAQPKGDPRIEYQFFEDRHSAIKLRPKEGETYFDVVAVVDPVTREAQRLAPLLLVLAQLINMNLRVFMNCQSKLSDMPLKSFYRYVLEPEISFTSDNSFAKGPIAKFLDMPQSPLFTLNLNTPESWMVESVRTPYDLDNIYLEEVDSVVAAEYELEYLLLEGHCYDITTGQPPRGLQFTLGTSANPVIVDTIVMANLGYFQLKANPGAWILRLRKGRSEDIYRIYSHDGTDSPPDADEVVIVLNNFKSKIIKVKVQKKADMVNEDLLSDGTSENESGFWDSFKWGFTGQKTEEVKQDKDDIINIFSVASGHLYERFLRIMMLSVLKNTKTPVKFWFLKNYLSPTFKEFIPYMANEYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAVRIVPEWQDYDQEIKQLQIRFQKEKETGALYKEKTKEPSREGPQKREEL

SEQ ID NO: 69204 - protein, 280 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKLVY

SEQ ID NO: 69205 - protein, 278 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKS

SEQ ID NO: 69206 - protein, 261 aa, Homo sapiens [sequence omitted]

SEQ ID NO: 69207 - protein, 1516 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDSIKLMKDISQNFPIKARSLTRIAVNQHMREEIKENQKDLQVRFKIQPGDARLFINGLRVDMDVYDAFSILDMLKLEGKMMNGLRNLGINGEDMSKFLKLNSHIWEYTYVLDIRHSSIMWINDLENDDLYITWPTSCQKLLKPVFPGSVPSIRRNFHNLVLFIDPAQEYTLDFIKLADVFYSHEVPLRIGFVFILNTDDEVDGANDAGVALWRAFNYIAEEFDISEAFISIVHMYQKVKKDQNILTVDNVKSVLQNTFPHANIWDILGIHSKYDEERKAGASFYKMTGLGPLPQALYNGEPFKHEEMNIKELKMAVLQRMMDASVYLQREVFLGTLNDRTNAIDFLMDRNNVVPRINTLILRTNQQYLNLISTSVTADVEDFSTFFFLDSQDKSAVIAKNMYYLTQDDESIISAVTLWIIADFDKPSGRKLLFNALKHMKTSVHSRLGIIYNPTSKINEENTAISRGILAAFLTQKNMFLRSFLGQLAKEEIATAIYSGDKIKTFLIEGMDKNAFEKKYNTVGVNIFRTHQLFCQDVLKLRPGEMGIVSNGRFLGPLDEDFYAEDFYLLEKITFSNLGEKIKGIVENMGINANNMSDFIMKVDALMSSVPKRASRYDVTFLRENHSVIKTNPQENDMFFNVIAIVDPLTREAQKMAQLLVVLGKIINMKIKLFMNCRGRLSEAPLESFYRFVLEPELMSGANDVSSLGPVAKFLDIPESPLLILNMITPEGWLVETVHSNCDLDNIHLKDTEKTVTAEYELEYLLLEGQCFDKVTEQPPRGLQFTLGTKNKPAVVDTIVMAHHGYFQLKANPGAWILRLHQGKSEDIYQIVGHEGTDSQADLEDIIVVLNSFKSKILKVKVKKETDKIKEDILTDEDEKTKGLWDSIKSFTVSLHKENKKEKDVLNIFSVASGHLYERFLRIMMLSVLRNTKTPVKFWLLKNYLSPTFKEVIPHMAKEYGFRYELVQYRWPRWLRQQTERQRIIWGYKILFLDVLFPLAVDKIIFVDADQIVRHDLKELRDFDLDGAPYGYTPFCDSRREMDGYRFWKTGYWASHLLRRKYHISALYVVDLKKFRRIGAGDRLRSQYQALSQDPNSLSNLDQDLPNNMIYQVAIKSLPQDWLWCETWCDDESKQRAKTIDLCNNPKTKESKLKAAARIVPEWVEYDAEIRQLLDHLENKKQDTILTHDEL

SEQ ID NO: 69208 - protein, 372 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDSIKLMKDISQNFPIKARLRMNILICLFQSTLNVKNLRSRHLYNKT

SEQ ID NO: 69209 - protein, 508 aa, Homo sapiens
MSRFVQDLSKAMSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 69210 - protein, 497 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 69211 - protein, 517 aa, Homo sapiens
MLLYPAGFSFASLKSDLSKAMSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 69212 - protein, 497 aa, Homo sapiens; identical to SEQ ID NO: 69210

SEQ ID NO: 69213 - protein, 150 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVL

SEQ ID NO: 69214 - protein, 171 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCR

SEQ ID NO: 69215 - protein, 38 aa, Homo sapiens
MSQDGASQFQEVIRQELELSVKKELEKILTTASSHEFE

SEQ ID NO: 69216 - protein, 105 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGG

SEQ ID NO: 69217 - protein, 49 aa, Homo sapiens
MSRFVQDLSKAMSQDGASQFQEVIRQELELSVKKELEKILTTASSHEFE

SEQ ID NO: 69218 - protein, 135 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQI

SEQ ID NO: 69219 - protein, 213 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHG

SEQ ID NO: 69220 - protein, 425 aa, Homo sapiens
MVSKALLRLVSAVNRRRMKLLLGIALLAYVASVWGNFVNMSFLLNRSIQENGELKIESKIEEMVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 69221 - protein, 252 aa, Homo sapiens
MYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 69222 - protein, 420 aa, Homo sapiens
MVSKALLRLVSAVNRRRMKLLLGIALLAYVASVWGNFVNMRSIQENGELKIESKIEEMVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 69223 - protein, 134 aa, Homo sapiens
MYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYV

SEQ ID NO: 69224 - protein, 185 aa, Homo sapiens
MVSKALLRLVSAVNRRRMKLLLGIALLAYVAWLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLVSAPLPPLCRTAQTFVHL

SEQ ID NO: 69225 - protein, 52 aa, Homo sapiens
MYNPIKTLKTNTIGTLNMLGLAKRVGARLLLASTSEVYGDPEVHPQSEDYWG

SEQ ID NO: 69226 - protein, 121 aa, Homo sapiens
MYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTV

SEQ ID NO: 69227 - protein, 363 aa, Homo sapiens
MVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 69228 - protein, 559 aa, Homo sapiens
MRKFAYCKVVLATSLIWVLLDMFLLLYFSECNKCDEKKERGLPAGDVLEPVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMIEEIVLVDDASERDFLKRPLESYVKKLKVPVHVIRMEQRSGLIRARLKGAAVSKGQVITFLDAHCECTVGWLEPLLARIKHDRRTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKNFFYIISPGVTKVDYGDISSRVGLRHKLQCKPFSWYLENIYPDSQIPRHYFSLGEIRNVETNQCLDNMARKENEKVGIFNCHGMGGNQVFSYTANKEIRTDDLCLDVSKLNGPVTMLKCHHLKGNQLWEYDPVKLTLQHVNSNQCLDKATEEDSQVPSIRDCNGSRSQQWLLRNVTLPEIF

SEQ ID NO: 69229 - protein, 499 aa, Homo sapiens [sequence omitted]

SEQ ID NO: 69230 - protein, 559 aa, Homo sapiens; identical to SEQ ID NO: 69228

SEQ ID NO: 69231 - protein, 603 aa, Homo sapiens
MRRKEKRLLQAVALVLAALVLLPNVGLWALYRERQPDGTPGGSGAAVAPAAGQGSHSRQKKTFFLGDGQKLKDWHDKEAIRRDAQRVGNGEQGRPYPMTDAERVDQAYRENGFNIYVSDKISLNRSLPDIRHPNCNSKRYLETLPNTSIIIPFHNEGWSSLLRTVHSVLNRSPPELVAEIVLVDDFSDREHLKKPLEDYMALFPSVRILRTKKREGLIRTRMLGASVATGDVITFLDSHCEANVNWLPPLLDRIARNRKTIVCPMIDVIDHDDFRYETQAGDAMRGAFDWEMYYKRIPIPPELQKADPSDPFESPVMAGGLFAVDRKWFWELGGYDPGLEIWGGEQYEISFKVWMCGGRMEDIPCSRVGHIYRKYVPYKVPAGVSLARNLKRVAEVWMDEYAEYIYQRRPEYRHLSAGDVAVQKKLRSSLNCKSFKWFMTKIAWDLPKFYPPVEPPAAAWGEIRNVGTGLCADTKHGALGSPLRLEGCVRGRGEAAWNNMQVFTFTWREDIRPGDPQHTKKFCFDAISHTSPVTLYDCHSMKGNQLWKYRKDKTLYHPVSGSCMDCSESDHRIFMNTCNPSSLTQQWLFEHTNSTVLEKFNRN

SEQ ID NO: 69232 - protein, 276 aa, Homo sapiens
MLAWRDGELEAETSSSLFLLAMQVWMCGGRMEDIPCSRVGHIYRKYVPYKVPAGVSLARVRNLKRVAEVWMDEYAEYIYQRRPEYRHLSAGDVAVQKKLRSSLNCKSFKWFMTKIAWDLPKFYPPVEPPAAAWGEIRNVGTGLCADTKHGALGSPLRLEGCVRGRGEAAWNNMQVFTFTWREDIRPGDPQHTKKFCFDAISHTSPVTLYDCHSMKGNQLWKYRKDKTLYHPVSGSCMDCSESDHRIFMNTCNPSSLTQQWLFEHTNSTVLEKFNRN

SEQ ID NO: 69233 - protein, 541 aa, Homo sapiens
MRRKEKRLLQAVALVLAALVLLPNVGLWALYRERQPDGTPGGSGAAVAPAAGQGSHSRQKKTFFLGDGQKLKDWHDKEAIRRDAQRVGNGEQGRPYPMTDAERVDQAYRENGFNIYVSDKISLNRSLPDIRHPNCNSKRYLETLPNTSIIIPFHNEGWSSLLRTVHSVLNRSPPELVAEIVLVDDFSDRDRIARNRKTIVCPMIDVIDHDDFRYETQAGDAMRGAFDWEMYYKRIPIPPELQKADPSDPFESPVMAGGLFAVDRKWFWELGGYDPGLEIWGGEQYEISFKVWMCGGRMEDIPCSRVGHIYRKYVPYKVPAGVSLARNLKRVAEVWMDEYAEYIYQRRPEYRHLSAGDVAVQKKLRSSLNCKSFKWFMTKIAWDLPKFYPPVEPPAAAWGEIRNVGTGLCADTKHGALGSPLRLEGCVRGRGEAAWNNMQVFTFTWREDIRPGDPQHTKKFCFDAISHTSPVTLYDCHSMKGNQLWKYRKDKTLYHPVSGSCMDCSESDHRIFMNTCNPSSLTQQWLFEHTNSTVLEKFNRN

SEQ ID NO: 69234 - protein, 366 aa, Homo sapiens
MRRKEKRLLQAVALVLAALVLLPNVGLWALYRERQPDGTPGGSGAAVAPAAGQGSHSRQKKTFFLGDGQKLKDWHDKEAIRRDAQRVGNGEQGRPYPMTDAERVDQAYRENGFNIYVSDKISLNRSLPDIRHPNCNSKRYLETLPNTSIIIPFHNEGWSSLLRTVHSVLNRSPPELVAEIVLVDDFSDREHLKKPLEDYMALFPSVRILRTKKREGLIRTRMLGASVATGDVITFLDSHCEANVNWLPPLLDRIARNRKTIVCPMIDVIDHDDFRYETQAGDAMRGAFDWEMYYKRIPIPPELQKADPSDPFESPVMAGGLFAVDRKWFWELGGYDPGLEIWGGEQYEISFKVSQLSRRPVLGTAS

SEQ ID NO: 69235 - protein, 581 aa, Homo sapiens [sequence omitted]

SEQ ID NO: 69236 - protein, 556 aa, Homo sapiens
MRRFVYCKVVLATSLMWVLVDVFLLLYFSECNKCDDKKERSLLPALRAVISRNQEGPGEMGKAVLIPKDDQEKMKELFKINQFNLMASDLIALNRSLPDVRLEGCKTKVYPDELPNTSVVIVFHNEAWSTLLRTVYSVINRSPHYLLSEVILVDDASERDFLKLTLENYVKNLEVPVKIIRMEERSGLIRARLRGAAASKGQVITFLDAHCECTLGWLEPLLARIKEDRKTVVCPIIDVISDDTFEYMAGSDMTYGGFNWKLNFRWYPVPQREMDRRKGDRTLPVRTPTMAGGLFSIDRNYFEEIGTYDAGMDIWGGENLEMSFRIWQCGGSLEIVTCSHVGHVFRKATPYTFPGGTGHVINKNNRRLAEVWMDEFKDFFYIISPGVVKVDYGDVSVRKTLRENLKCKPFSWYLENIYPDSQIPRRYYSLGEIRNVETNQCLDNMGRKENEKVGIFNCHGMGGNQVFSYTADKEIRTDDLCLDVSRLNGPVIMLKCHHMRGNQLWEYDAERLTLRHVNSNQCLDEPSEEDKMVPTMQDCSGSRSQQWLLRNMTLGT

SEQ ID NO: 69237 - protein, 561 aa, Homo sapiens
MRRFVYCKVVLATSLMWVLVDVFLLLYFSECNKCDDKKERSLLPALRAVISRNQEGPGEMGKAVLIPKDDQEKMKELFKINQFNLMASDLIALNRSLPDVRLEGCKTKVYPDELPNTSVVIVFHNEAWSTLLRTVYSVINRSPHYLLSEVILVDDASERDFLKLTLENYVKNLEVPVKIIRMEERSGLIRARLRGAAASKGQVITFLDAHCECTLGWLEPLLARIKEDRKTVVCPIIDVISDDTFEYMAGSDMTYGGFNWKLNFRWYPVPQREMDRRKGDRTLPVRTPTMAGGLFSIDRNYFEEIGTYDAGMDIWGGENLEMSFRIWQCGGSLEIVTCSHVGHVFRKATPYTFPGGTGHVINKNNRRLAEVWMDEFKDFFYIISPGVVKVDYGDVSVRKTLRENLKCKPFSWYLENIYPDSQIPRRYYSLGEIRNVETNQCLDNMGRKENEKVGIFNCHGMGGNQVFSYTADKEIRTDDLCLDVSRLNGPVIMLKCHHMRGNQLWEYDAESCLSVNKVADGSQHPTVETCNDSTLQKWLLRNYTRMEIFRNIFGNSTDYIL

SEQ ID NO: 69238 - protein, 19 aa, Homo sapiens
MRRFVYCKVVLATSLMWVL

SEQ ID NO: 69239 - protein, 552 aa, Homo sapiens
MRRLTRRLVLPVFGVLWITVLLFFWVTKRKLEVPTGPEVQTPKPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 69240 - protein, 519 aa, Homo sapiens
MRRLTRRLVLPVFGVLWITVLLFFWVTKRKLEVPTGPEVQTPKPSDADWDDLWDQFDERRYLNAKKWRVGDDPYKLYAFNQRESERISSNRAIPDTRHLSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 69241 - protein, 532 aa, Homo sapiens
MSFPMSLARSSVPFADSGLSSSQPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 69242 - protein, 517 aa, Homo sapiens
MAQDESCPPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 69243 - protein, 557 aa, Homo sapiens
MRRLTRRLVLPVFGVLWITVLLFFWVTKRKLEVPTGPEVQTPKVWSLFFKVAGMSPWAPQVPVSPTPPYQRGHLPTGGHLAVCHFPCLLQEAQFHLQTQVFLQVRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 69244 - protein, 571 aa, Homo sapiens
MRRRSRMLLCFAFLWVLGIAYYMYSGGGSALAGGAGGGAGRKEDWNEIDPIKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 69245 - protein, 265 aa, Homo sapiens
MVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKDLVPRVAVWWQPGDHPVQPCGTRVPEAAPLHVPGWQWHCLCPKHPPGSRGLDG

SEQ ID NO: 69246 - protein, 361 aa, Homo sapiens
MRRRSRMLLCFAFLWVLGIAYYMYSGGGSALAGGAGGGAGRKEDWNEIDPIKKKDLHHSNGAEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHVAGLRQ

SEQ ID NO: 69247 - protein, 533 aa, Homo sapiens
MADREDWNEIDPIKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 69248 - protein, 633 aa, Homo sapiens
MAHLKRLVKLHIKRHYHKKFWKLGAVIFFFIIVLVLMQREVSVQYSKEESRMERNMKNKNKMLDLMLEAVNNIKDAMPKMQIGAPVRQNIDAGERPCLQGYYTAAELKPVLDRPPQDSNAPGASGKAFKTTNLSVEEQKEKERGEAKHCFNAFASDRISLHRDLGPDTRPPECIEQKFKRCPPLPTTSVIIVFHNEAWSTLLRTVHSVLYSSPAILLKEIILVDDASVDEYLHDKLDEYVKQFSIVKIVRQRERKGLITARLLGATVATAETLTFLDAHCECFYGWLEPLLARIAENYTAVVSPDIASIDLNTFEFNKPSPYGSNHNRGNFDWSLSFGWESLPDHEKQRRKDETYPIKTPTFAGGLFSISKEYFEYIGSYDEEMEIWGGENIEMSFRVWQCGGQLEIMPCSVVGHVFRSKSPHSFPKGTQVIARNQVRLAEVWMDEYKEIFYRRNTDAAKIVKQKAFGDLSKRFEIKHRLQCKNFTWYLNNIYPEVYVPDLNPVISGYIKSVGQPLCLDVGENNQGGKPLIMYTCHGLGGNQYFEYSAQHEIRHNIQKELCLHAAQGLVQLKACTYKGHKTVVTGEQIWEIQKDQLLYNPFLKMCLSANGEHPSLVSCNPSDPLQKWILSQND

SEQ ID NO: 69249 - protein, 464 aa, Homo sapiens
MAHLKRLVKLHIKRHYHKKFWKLGAVIFFFIIVLVLMQREVSVQYSKEESRMERNMKNKNKMLDLMLEAVNNIKDAMPKMQIGAPVRQNIDAGERPCLQGYYTAAELKPVLDRPPQDSNAPGASGKAFKTTNLSVEEQKEKERGEAKHCFNAFASDRISLHRDLGPDTRPPECIEQKFKRCPPLPTTSVIIVFHNEAWSTLLRTVHSVLYSSPAILLKEIILVDDASVDEYLHDKLDEYVKQFSIVKIVRQRERKGLITARLLGATVATAETLTFLDAHCECFYGWLEPLLARIAENYTAVVSPDIASIDLNTFEFNKPSPYGSNHNRGNFDWSLSFGWESLPDHEKQRRKDETYPIKTPTFAGGLFSISKEYFEYIGSYDEEMEIWGGENIEMSFRVWQCGGQLEIMPCSVVGHVFRSKSPHSFPKGTQVIARNQVRLAEVWMDEYKEIFYRRNTDAAKIVKQ

SEQ ID NO: 69250 - protein, 57 aa, Homo sapiens
MAHLKRLVKLHIKRHYHKKFWKLGAVIFFFIIVLVLMQREVSVQYSKEESRMERNMK

SEQ ID NO: 69251 - protein, 25 aa, Homo sapiens
MAHLKRLVKLHIKRHYHKKFWKLGA

SEQ ID NO: 69252 - protein, 90 aa, Homo sapiens
MAHLKRLVKLHIKRHYHKKFWKLGAVIFFFIIVLVLMQREVSVQYSKEESRMERNMKNKNKMLDLMLEAVNNIKDAMPKMQIGAPVRQNI

SEQ ID NO: 69253 - protein, 11 aa, Homo sapiens
MAHLKRLVKLH

SEQ ID NO: 69254 - protein, 578 aa, Homo sapiens
MAVRWTWAGKSCLLLAFLTVAYIFVELLVSTFHASAGAGRARELGSRRLSDLQKNTEDLSRPLYKKPPADSRALGEWGKASKLQLNEDELKQQEELIERYAINIYLSDRISLHRHIEDKRMYECKSQKFNYRTLPTTSVIIAFYNEAWSTLLRTIHSVLETSPAVLLKEIILVDDLSDRVYLKTQLETYISNLDRVRLIRTNKREGLVRARLIGATFATGDVLTFLDCHCECNSGWLEPLLERIGRDETAVVCPVIDTIDWNTFEFYMQIGEPMIGGFDWRLTFQWHSVPKQERDRRISRIDPIRSPTMAGGLFAVSKKYFQYLGTYDTGMEVWGGENLELSFRVWQCGGKLEIHPCSHVGHVFPKRAPYARPNFLQNTARAAEVWMDEYKEHFYNRNPPARKEAYGDISERKLLRERLRCKSFDWYLKNVFPNLHVPEDRPGWHGAIRSRGISSECLDYNSPDNNPTGANLSLFGCHGQGGNQFFEYTSNKEIRFNSVTELCAEVPEQKNYVGMQNCPKDGFPVPANIIWHFKEDGTIFHPHSGLCLSAYRTPEGRPDVQMRTCDALDKNQIWSFEK

SEQ ID NO: 69255 - protein, 622 aa, Homo sapiens
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKSKWTPLETQEKEEGYKKHCFNAFASDRISLQRSLGPDTRPPECVDQKFRRCPPLATTSVIIVFHNEAWSTLLRTVYSVLHTTPAILLKEIILVDDASTEEHLKEKLEQYVKQLQVVRVVRQEERKGLITARLLGASVAQAEVLTFLDAHCECFHGWLEPLLARIAEDKTVVVSPDIVTIDLNTFEFAKPVQRGRVHSRGNFDWSLTFGWETLPPHEKQRRKDETYPIKSPTFAGGLFSISKSYFEHIGTYDNQMEIWGGENVEMSFRVWQCGGQLEIIPCSVVGHVFRTKSPHTFPKGTSVIARNQVRLAEVWMDSYKKIFYRRNLQAAKMAQEKSFGDISERLQLREQLHCHNFSWYLHNVYPEMFVPDLTPTFYGAIKNLGTNQCLDVGENNRGGKPLIMYSCHGLGGNQYFEYTTQRDLRHNIAKQLCLHVSKGALGLGSCHFTGKNSQVPKDEEWELAQDQLIRNSGSGTCLTSQDKKPAMAPCNPSDPHQLWLFV

SEQ ID NO: 69256 - protein, 622 aa, Homo sapiens; identical to SEQ ID NO: 69255

SEQ ID NO: 69257 - protein, 603 aa, Homo sapiens
MRLLRRRHMPLRLAMVGCAFVLFLFLLVSRKDHVLDLMLEAMNNLRDSMPKLQIRAPEAQQTLFSINQSCLPGFYTPAELKPFWERPPQDPNAPGADGKAFQKSKWTPLETQEKEEGYKKHCFNAFASDRISLQRSLGPDTRPPECVDQKFRRCPPLATTSVIIVFHNEAWSTLLRTVYSVLHTTPAILLKEIILVDDASTEEHLKEKLEQYVKQLQVVRVVRQEERKGLITARLLGASVAQAEVLTFLDAHCECFHGWLEPLLARIAEDKTVVVSPDIVTIDLNTFEFAKPVQRGRVHSRGNFDWSLTFGWETLPPHEKQRRKDETYPIKSPTFAGGLFSISKSYFEHIGTYDNQMEIWGGENVEMSFRVWQCGGQLEIIPCSVVGHVFRTKSPHTFPKGTSVIARNQVRLAEVWMDSYKKIFYRRNLQAAKMAQEKSFGDISERLQLREQLHCHNFSWYLHNVYPEMFVPDLTPTFYGAIKNLGTNQCLDVGENNRGGKPLIMYSCHGLGGNQYFEYTTQRDLRHNIAKQLCLHVSKGALGLGSCHFTGKNSQVPKDEEWELAQDQLIRNSGSGTCLTSQDKKPAMAPCNPSDPHQLWLFV

SEQ ID NO: 69258 - protein, 657 aa, Homo sapiens
MRLKIGFILRSLLVVGSFLGLVVLWSSLTPRPDDPSPLSRMREDRDVNDPMPNRGGNGLAPGEDRFKPVVPWPHVEGVEVDLESIRRINKAKNEQEHHAGGDSQKDIMQRQYLTFKPQTFTYHDPVLRPGILGNFEPKEPEPPGVVGGPGEKAKPLVLGPEFKQAIQASIKEFGFNMVASDMISLDRSVNDLRQEECKYWHYDENLLTSSVVIVFHNEGWSTLMRTVHSVIKRTPRKYLAEIVLIDDFSNKEHLKEKLDEYIKLWNGLVKVFRNERREGLIQARSIGAQKAKLGQVLIYLDAHCEVAVNWYAPLVAPISKDRTICTVPLIDVINGNTYEIIPQGGGDEDGYARGAWDWSMLWKRVPLTPQEKRLRKTKTEPYRSPAMAGGLFAIEREFFFELGLYDPGLQIWGGENFEISYKIWQCGGKLLFVPCSRVGHIYRLEGWQGNPPPIYVGSSPTLKNYVRVVEVWWDEYKDYFYASRPESQALPYGDISELKKFREDHNCKSFKWFMEEIAYDITSHYPLPPKNVDWGEIRGFETAYCIDSMGKTNGGFVELGPCHRMGGNQLFRINEANQLMQYDQCLTKGADGSKVMITHCNLNEFKEWQYFKNLHRFTHIPSGKCLDRSEVLHQVFISNCDSSKTTQKWEMNNIHSV

SEQ ID NO: 69259 - protein, 238 aa, Homo sapiens
MRTVHSVIKRTPRKYLAEIVLIDDFSNKEHLKEKLDEYIKLWNGLVKVFRNERREGLIQARSIGAQKAKLGQVLIYLDAHCEVAVNWYAPLVAPISKDRTTCTVPLIDYIDGNDYSIEPQQGGDEDGFARGAWDWSLLWKRIPLSHKEKAKRKHKTEPYRSPAMAGGLFAIEREFFFELGLYDPGLQIWGGKTLRSHTRYGSVVANYYLFLVLVLDISTVLRAGKEILRPFMLGLLQL

SEQ ID NO: 69260 - protein, 637 aa, Homo sapiens
MMFWRKLPKALFIGLTLAIAVNLLLVFSSKGTLQNLFTGGLHRELPLHLNKRYGAVIKRLSHLEVELQDLKESMKLALRQQENVNSTLKRAKDEVRPLLKAMETKVNETKKHKTQMKLFPHSQLFRQWGEDLSEAQQKAAQDLFRKFGYNAYLSNQLPLNRTIPDTRDYRCLRKTYPSQLPSLSVILIFVNEALSIIQRAITSIINRTPSRLLKEIILVDDFSSNGELKVHLDEKIKLYNQKYPGLLKIIRHPERKGLAQARNTGWEAATADVVAILDAHIEVNVGWAEPILARIQEDRTVIVSPVFDNIRFDTFKLDKYELAVDGFNWELWCRYDALPQAWIDLHDVTAPVKSPSIMGILAANRHFLGEIGSLDGGMLIYGGENVELSLRVWQCGGKVEILPCSRIAHLERHHKPYALDLTAALKRNALRVAEIWMDEHKHMVYLAWNIPLQNSGIDFGDVSSRMALREKLKCKTFDWYLKNVYPLLKPLHTIVGYGRMKNLLDENVCLDQGPVPGNTPIMYYCHEFSSQNVYYHLTGELYVGQLIAEASASDRCLTDPGKAEKPTLEPCSKAAKNRLHIYWDFKPGGAVINRDTKRCLEMKKDLLGSHVLVLQTCSTQVWEIQHTVRDWGQTNSQ

SEQ ID NO: 69261 - protein, 215 aa, Homo sapiens
MEFDCEGLRRLLGKYKFRDLTVEELRNVNVFFPHFKYSMDTYVFKDSSQKDLLNFTGTIPVMYQGNTYNIPIRFWILDSHPFAPPICFLKPTANMGILVGKHVDAQGRIYLPYLQNWSHPKSVIVGLIKEMIAKFQEELPMYSLSSSDEARQVDLLAYIAKITEGVSDTNSKSWANHENKTVNKITVVGGGELGIACTLAISAKVESRSVTQAGV

SEQ ID NO: 69262 - protein, 471 aa, Homo sapiens
MEFDCEGLRRLLGKYKFRDLTVEELRNVNVFFPHFKYSMDTYVFKDSSQKDLLNFTGTIPVMYQGNTYNIPIRFWILDSHPFAPPICFLKPTANMGILVGKHVDAQGRIYLPYLQNWSHPKSVIVGLIKEMIAKFQEELPMYSLSSSDEARQVDLLAYIAKITEGVSDTNSKSWANHENKTVNKITVVGGGELGIACTLAISAKGIADRLVLLDLSEGTKGATMDLEIFNLPNVEISKDLSASAHSKVVIFTVNSLGSSQSYLDVVQSNVDMFRALVPALGHYSQHSVLLVASQPVEIMTYVTWKLSTFPANRVIGIGCNLDSQRLQYIITNVLKAQTSGKEVWVIGEQGEDKVLTWSGQEEVVSHTSQVQLSNRAMELLRVKGQRSWSVGLSVADMVDSIVNNKKKVHSVSALAKGYYDINSEVFLSLPCILGTNGVSEVIKTTLKEDTVTEKLQSSASSIHSLQQQLKL

SEQ ID NO: 69263 - protein, 248 aa, Homo sapiens
MDLEIFNLPNVEISKDLSASAHSKVVIFTVNSLGSSQSYLDVVQSNVDMFRALVPALGHYSQHSVLLVASQPVEIMTYVTWKLSTFPANRVIGIGCNLDSQRLQYIITNVLKAQTSGKEVWVIGEQGEDKVLTWSGQEEVVSHTSQVQLSNRAMELLRVKGQRSWSVGLSVADMVDSIVNNKKKVHSVSALAKGYYDINSEVFLSLPCILGTNGVSEVIKTTLKEDTVTEKLQSSASSIHSLQQQLKL

SEQ ID NO: 69264 - protein, 379 aa, Homo sapiens
MEFDCEGLRRLLGKYKFRDLTVEELRNVNVFFPHFKYSMDTYVFKDSSQKDLLNFTGTIPVMYQGNTYNIPIRFWILDSHPFAPPICFLKPTANMGILVGKHVDAQGRIYLPYLQNWSHPKSVIVGLIKEMIAKFQEELPMYSLSSSDEARQVDLLAYIAKITEGVSDTNSKSWANHENKTVNKITVVGGGELGIACTLAISAKGIADRLVLLDLSEGTKGATMDLEIFNLPNVEISKDLSASAHSKVVIFTVNSLGSSQSYLDVVQSNVDMFRALVPALGHYSQHSVLLVASQPVEIMTYVTWKLSTFPANRVIGIGCNLDSQRLQYIITNVLKAQTSGKEVWVIGEQGEDKVLTWSGQEEVVSHTSQVQLSNRDIMI

SEQ ID NO: 69265 - protein, 449 aa, Homo sapiens
MEFDCEGLRRLLGKYKFRDLTVEELRNVNVFFPHFKYSMDTYGNTYNIPIRFWILDSHPFAPPICFLKPTANMGILVGKHVDAQGRIYLPYLQNWSHPKSVIVGLIKEMIAKFQEELPMYSLSSSDEARQVDLLAYIAKITEGVSDTNSKSWANHENKTVNKITVVGGGELGIACTLAISAKGIADRLVLLDLSEGTKGATMDLEIFNLPNVEISKDLSASAHSKVVIFTVNSLGSSQSYLDVVQSNVDMFRALVPALGHYSQHSVLLVASQPVEIMTYVTWKLSTFPANRVIGIGCNLDSQRLQYIITNVLKAQTSGKEVWVIGEQGEDKVLTWSGQEEVVSHTSQVQLSNRAMELLRVKGQRSWSVGLSVADMVDSIVNNKKKVHSVSALAKGYYDINSEVFLSLPCILGTNGVSEVIKTTLKEDTVTEKLQSSASSIHSLQQQLKL

SEQ ID NO: 69266 - protein, 142 aa, Homo sapiens
MGDKPPGFRGSRDWIGCVEASLCLAHFGGPQGRLCHVPRGVGLHGELERLYSHFAGGGGPVMVGGDADARSKALLGVCVGSGTEAYVLVLDPHYWGTPKSPSELQAAGWVGWQEVSAAFDPNSFYNLCLTSLSSQQQQRTLD

SEQ ID NO: 69267 - protein, 469 aa, Homo sapiens
MVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLVTISYPSGIPDGQLQAYRKELHDLFNLPHDRPYFKRSNAYHFPDEPYKDGYIRNPHTYLNPPNMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSQGSEIASQGRELANHFQSEGTPVMIGGGVLAHTILGVAWNEITGQIKFLILDPHYTGAEDLQVILEKGWCGWKGPDFWNKDAYYNLCLPQRPNMI

SEQ ID NO: 69268 - protein, 244 aa, Homo sapiens
MAAAASPAFLLCLPLLHLLSGWSRAGWVDTHCLCYDFIITPKSRPEPQWCEVQGLVDERPFLHYDCVNHKAKAFASLGKKVNVTKTWEEQTETLRDVVDFLKGQLLDIQVENLIPIEPLTLQARMSCEHEAHGHGRGSWQFLFNGQKFLLFDSNNRKWTALHPGAKKMTEKWEKNRDVTMFFQKISLGDCKMWLEEFLMYWEQMLDPTKPPSLAPGTTQPKAMATTLSPWSLLIIFLCFILAGR

SEQ ID NO: 69269 - protein, 244 aa, Homo sapiens; identical to SEQ ID NO: 69268

SEQ ID NO: 69270 - protein, 246 aa, Homo sapiens
MAAAAATKILLCLPLLLLLSGWSRAGRADPHSLCYDITVIPKFRPGPRWCAVQGQVDEKTFLHYDCGNKTVTPVSPLGKKLNVTTAWKAQNPVLREVVDILTEQLRDIQLENYTPKEPLTLQARMSCEQKAEGHSSGSWQFSFDGQIFLLFDSEKRMWTTVHPGARKMKEKWENDKVVAMSFHYFSMGDCIGWLEDFLMGMDSTLEPSAGAPLAMSSGTTQLRATATTLILCCLLIILPCFILPGI

SEQ ID NO: 69271 - protein, 169 aa, Homo sapiens
MAAAASPAILPRLAILPYLLFDWSGTGRADAHSLWYNFTIIHLPRHGQQWCEVQSQVDQKNFLSYDCGSDKVLSMGHLEEQLYATDAWGKQLEMLREVGQRLRLELADTELEDFTPSGPLTLQVRMSCECEADGYIRGSWQFSFDGRKFLLFDSNNRKWTVVHAGLGTS

SEQ ID NO: 69272 - protein, 244 aa, Homo sapiens
MAAAASPAILPRLAILPYLLFDWSGTGRADAHSLWYNFTIIHLPRHGQQWCEVQSQVDQKNFLSYDCGSDKVLSMGHLEEQLYATDAWGKQLEMLREVGQRLRLELADTELEDFTPSGPLTLQVRMSCECEADGYIRGSWQFSFDGRKFLLFDSNNRKWTVVHAGARRMKEKWEKDSGLTTFFKMVSMRDCKSWLRDFLMHRKKRLEPTAPPTMAPGLAQPKAIATTLSPWSFLIILCFILPGI

SEQ ID NO: 69273 - protein, 130 aa, Homo sapiens [sequence omitted]

SEQ ID NO: 69274 - protein, 244 aa, Homo sapiens; identical to SEQ ID NO: 69272

SEQ ID NO: 69275 - protein, 220 aa, Homo sapiens
MKVKKGGGGAGTATESAPGPSGQSVAPIPQPPAESESGSESEPDAGPGPRPGPLQRKQPIGPEDVLGLQRITGDYLCSPEENIYKIDFVRFKIRDMDSGTVLFEIKKPPVSERLPINRRDLDPNAGRFVRYQFTPAFLRLRQVGATVEFTVGDKPVNNFRMIERHYFRNQLLKSFDFHFGFCIPSSKNTCEHIYDFPPLSEELSARAGSSGSGEVGASRD

SEQ ID NO: 69276 - protein, 240 aa, Homo sapiens
MKVKKGGGGAGTATESAPGPSGQSVAPIPQPPAESESGSESEPDAGPGPRPGPLQRKQPIGPEDVLGLQRITGDYLCSPEENIYKIDFVRFKIRDMDSGTVLFEIKKPPVSERLPINRRDLDPNAGRFVRYQFTPAFLRLRQVGATVEFTVGDKPVNNFRMIERHYFRNQLLKSFDFHFGFCIPSSKNTCEHIYDFPPLSEELISEMIRHPYETQSDSFYFVDDRLVMHNKADYSYSGTP

SEQ ID NO: 69277 - protein, 208 aa, Homo sapiens
MKVKKGGGGAGTATESAPGPSGQSVAPIPQPPAESESGSESEPDAGPGPRPGPLQRKQPIGPEDVLGLQRITGGARPLFPAWRFKIRDMDSGTVLFEIKKPPVSERLPINRRDLDPNAGRFVRYQFTPAFLRLRQVGATVEFTVGDKPVNNFRMIERHYFRNQLLKSFDFHFGFCIPSSKNTCEHIYDFPPLSEELSARAGSSGSGEV

SEQ ID NO: 69278 - protein, 1703 aa, Homo sapiens
LSLLCVSLKKAKFDGAQEKFNTYVTLKVQNVKSTTIAVRGSQPSWEQDFMFEINRLDLGLTVEVWNKGLIWDTMVGTVWIPLRTIRQSNEEGPGEWLTLDSQVIMADSEICGTKDPTFHRILLDTRFELPLDIPEEEARYWAKKLEQLNAMRDQDEYSFQDEQDKPLPVPSNQCCNWNYFGWGEQHNDDPDSAVDDRDSDYRSETSNSIPPPYYTTSQPNASVHQYSVRPPPLGSRESYSDSMHSYEEFSEPQALSPTGSSRYASSGELSQGSSQLSEDFDPDEHSLQGSDMEDERDRDSYHSCHSSVSYHKDSPRWDQDEEELEEDLEDFLEEEELPEDEEELEEEEEEVPDDLGSYAQREDVAVAEPKDFKRISLPPAAPGKEDKAPVAPTEAPDMAKVAPKPATPDKVPAAEQIPEAEPPKDEESFRPREDEEGQEGQDSMSRAKANWLRAFNKVRMQLQEARGEGEMSKSLWFKGGPGGGLIIIDSMPDIRKRKPIPLVSDLAMSLVQSRKAGITSALASSTLNNEELKNHVYKKTLQALIYPISCTTPHNFEVWTATTPTYCYECEGLLWGIARQGMRCTECGVKCHEKCQDLLNADCLQRAAEKSSKHGAEDRTQNIIMVLKDRMKIRERNKPEIFELIQEIFAVTKTAHTQQMKAVKQSVLDGTSKWSAKISITVVCAQGLQAKDKTGSSDPYVTVQVGKTKKRTKTIYGNLNPVWEENFHFECHNSSDRIKVRVWDEDDDIKSRVKQRFKRESDDFLGQTIIEVRTLSGEMDVWYNLDKRTDKSAVSGAIRLHISVEIKGEEKVAPYHVQYTCLHENLFHFVTDVQNNGVVKIPDAKGDDAWKVYYDETAQEIVDEFAMRYGVESIYQAMTHFACLSSKYMCPGVPAVMSTLLANINAYYAHTTASTNVSASDRFAASNFGKERFVKLLDQLHNSLRIDLSMYRNNFPASSPERLQDLKSTVDLLTSITFFRMKVQELQSPPRASQVVKDCVKACLNSTYEYIFNNCHELYSREYQTDPAKKGEVLPEEQGPSIKNLDFWSKLITLIVSIIEEDKNSYTPCLNQFPQELNVGKISAEVMWNLFAQDMKYAMEEHDKHRLCKSADYMNLHFKVKWLYNEYVTELPAFKDRVPEYPAWFEPFVIQWLDENEEVSRDFLHGALERDKKDGFQQTSEHALFSCSVVDVFSQLNQSFEIIKKLECPDPQIVGHYMRRFAKTISNVLLQYADIISKDFASYCSKEKEKVPCILMNNTQQLRVQLEKMFEAMGGKELDAEASDILKELQVKLNNVLDELSRVFATSFQPHIEECVKQMGDILSQVKGTGNVPASACSSVAQDADNVLQPIMDLLDSNLTLFAKICEKTVLKRVLKELWKLVMNTMEKTIVLPPLTDQTLQGNLLRKHGKGLEKGRVKLPSHSDGTQMIFNAAKELGQLSKLKDHMVREEAKSLTPKQCAVVELALDTIKQYFHAGGVGLKKTFLEKSPDLQSLRYALSLYTQATDLLIKTFVQTQSAQGLGVEDPVGEVSVHVELFTHPGTGEHKVTVKVVAANDLKWQTSGIFRPFIEVNIIGPQLSDKKRKFATKSKNNSWAPKYNESFQFTLSADAGPECYELQVCVKDYCFAREDRTVGLAVLQLRELAQRGSAACWLPLGRRIHMDDTGLTVLRILSQRSNDEVAKEFVKLKSDTRSAEEGGAAPAP

SEQ ID NO: 69279 - protein, 1791 aa, Homo sapiens
MGGGGTCTISVQVRVCTGGNLLGGRRRPLSPCNEEVWGEAPLPGARPFNAPPARSAPAPSGVPGLRLPAPHQRHSRPGRLRPTCELGDMSLLCVGVKKAKFDGAQEKFNTYVTLKVQNVKSTTIAVRGSQPSWEQDFMFEINRLDLGLTVEVWNKGLIWDTMVGTVWIPLRTIRQSNEEGPGEWLTLDSQVIMADSEICGTKDPTFHRILLDTRFELPLDIPEEEARYWAKKLEQLNAMRDQDEYSFQDEQDKPLPVPSNQCCNWNYFGWGEQHNDDPDSAVDDRDSDYRSETSNSIPPPYYTTSQPNASVHQYSVRPPPLGSRESYSDSMHSYEEFSEPQALSPTGSSRYASSGELSQGSSQLSEDFDPDEHSLQGSDMEDERDRDSYHSCHSSVSYHKDSPRWDQDEEELEEDLEDFLEEEELPEDEEELEEEEEEVPDDLGSYAQREDVAVAEPKDFKRISLPPAAPGKEDKAPVAPTEAPDMAKVAPKPATPDKVPAAEQIPEAEPPKDEESFRPREDEEGQEGQDSMSRAKANWLRAFNKVRMQLQEARGEGEMSKSLWFKGGPGGGLIIIDSMPDIRKRKPIPLVSDLAMSLVQSRKAGITSALASSTLNNEELKNHVYKKTLQALIYPISCTTPHNFEVWTATTPTYCYECEGLLWGIARQGMRCTECGVKCHEKCQDLLNADCLQRAAEKSSKHGAEDRTQNIIMVLKDRMKIRERNKPEIFELIQEIFAVTKTAHTQQMKAVKQSVLDGTSKWSAKISITVVCAQGLQAKDKTGSSDPYVTVQVGKTKKRTKTIYGNLNPVWEENFHFECHNSSDRIKVRVWDEDDDIKSRVKQRFKRESDDFLGQTIIEVRTLSGEMDVWYNLDKRTDKSAVSGAIRLHISVEIKGEEKVAPYHVQYTCLHENLFHFVTDVQNNGVVKIPDAKGDDAWKVYYDETAQEIVDEFAMRYGVESIYQAMTHFACLSSKYMCPGVPAVMSTLLANINAYYAHTTASTNVSASDRFAASNFGKERFVKLLDQLHNSLRIDLSMYRNNFPASSPERLQDLKSTVDLLTSITFFRMKVQELQSPPRASQVVKDCVKACLNSTYEYIFNNCHELYSREYQTDPAKKGEVLPEEQGPSIKNLDFWSKLITLIVSIIEEDKNSYTPCLNQFPQELNVGKISAEVMWNLFAQDMKYAMEEHDKHRLCKSADYMNLHFKVKWLYNEYVTELPAFKDRVPEYPAWFEPFVIQWLDENEEVSRDFLHGALERDKKDGFQQTSEHALFSCSVVDVFSQLNQSFEIIKKLECPDPQIVGHYMRRFAKTISNVLLQYADIISKDFASYCSKEKEKVPCILMNNTQQLRVQLEKMFEAMGGKELDAEASDILKELQVKLNNVLDELSRVFATSFQPHIEECVKQMGDILSQVKGTGNVPASACSSVAQDADNVLQPIMDLLDSNLTLFAKICEKTVLKRVLKELWKLVMNTMEKTIVLPPLTDQTMIGNLLRKHGKGLEKGRVKLPSHSDGTQMIFNAAKELGQLSKLKDHMVREEAKSLTPKQCAVVELALDTIKQYFHAGGVGLKKTFLEKSPDLQSLRYALSLYTQATDLLIKTFVQTQSAQGLGVEDPVGEVSVHVELFTHPGTGEHKVTVKVVAANDLKWQTSGIFRPFIEVNIIGPQLSDKKRKFATKSKNNSWAPKYNESFQFTLSADAGPECYELQVCVKDYCFAREDRTVGLAVLQLRELAQRGSAACWLPLGRRIHMDDTGLTVLRILSQRSNDEVAKEFVKLKSDTRSAEEGGAAPAP

SEQ ID NO: 69280 - protein, 1703 aa, Homo sapiens
MSLLCVGVKKAKFDGAQEKFNTYVTLKVQNVKSTTIAVRGSQPSWEQDFMFEINRLDLGLTVEVWNKGLIWDTMVGTVWIPLRTIRQSNEEGPGEWLTLDSQVIMADSEICGTKDPTFHRILLDTRFELPLDIPEEEARYWAKKLEQLNAMRDQDEYSFQDEQDKPLPVPSNQCCNWNYFGWGEQHNDDPDSAVDDRDSDYRSETSNSIPPPYYTTSQPNASVHQYSVRPPPLGSRESYSDSMHSYEEFSEPQALSPTGSSRYASSGELSQGSSQLSEDFDPDEHSLQGSDMEDERDRDSYHSCHSSVSYHKDSPRWDQDEEELEEDLEDFLEEEELPEDEEELEEEEEEVPDDLGSYAQREDVAVAEPKDFKRISLPPAAPGKEDKAPVAPTEAPDMAKVAPKPATPDKVPAAEQIPEAEPPKDEESFRPREDEEGQEGQDSMSRAKANWLRAFNKVRMQLQEARGEGEMSKSLWFKGGPGGGLIIIDSMPDIRKRKPIPLVSDLAMSLVQSRKAGITSALASSTLNNEELKNHVYKKTLQALIYPISCTTPHNFEVWTATTPTYCYECEGLLWGIARQGMRCTECGVKCHEKCQDLLNADCLQRAAEKSSKHGAEDRTQNIIMVLKDRMKIRERNKPEIFELIQEIFAVTKTAHTQQMKAVKQSVLDGTSKWSAKISITVVCAQGLQAKDKTGSSDPYVTVQVGKTKKRTKTIYGNLNPVWEENFHFECHNSSDRIKVRVWDEDDDIKSRVKQRFKRESDDFLGQTIIEVRTLSGEMDVWYNLDKRTDKSAVSGAIRLHISVEIKGEEKVAPYHVQYTCLHENLFHFVTDVQNNGVVKIPDAKGDDAWKVYYDETAQEIVDEFAMRYGVESIYQAMTHFACLSSKYMCPGVPAVMSTLLANINAYYAHTTASTNVSASDRFAASNFGKERFVKLLDQLHNSLRIDLSMYRNNFPASSPERLQDLKSTVDLLTSITFFRMKVQELQSPPRASQVVKDCVKACLNSTYEYIFNNCHELYSREYQTDPAKKGEVLPEEQGPSIKNLDFWSKLITLIVSIIEEDKNSYTPCLNQFPQELNVGKISAEVMWNLFAQDMKYAMEEHDKHRLCKSADYMNLHFKVKWLYNEYVTELPAFKDRVPEYPAWFEPFVIQWLDENEEVSRDFLHGALERDKKDGFQQTSEHALFSCSVVDVFSQLNQSFEIIKKLECPDPQIVGHYMRRFAKTISNVLLQYADIISKDFASYCSKEKEKVPCILMNNTQQLRVQLEKMFEAMGGKELDAEASDILKELQVKLNNVLDELSRVFATSFQPHIEECVKQMGDILSQVKGTGNVPASACSSVAQDADNVLQPIMDLLDSNLTLFAKICEKTVLKRVLKELWKLVMNTMEKTIVLPPLTDQTMIGNLLRKHGKGLEKGRVKLPSHSDGTQMIFNAAKELGQLSKLKDHMVREEAKSLTPKQCAVVELALDTIKQYFHAGGVGLKKTFLEKSPDLQSLRYALSLYTQATDLLIKTFVQTQSAQGLGVEDPVGEVSVHVELFTHPGTGEHKVTVKVVAANDLKWQTSGIFRPFIEVNIIGPQLSDKKRKFATKSKNNSWAPKYNESFQFTLSADAGPECYELQVCVKDYCFAREDRTVGLAVLQLRELAQRGSAACWLPLGRRIHMDDTGLTVLRILSQRSNDEVAKEFVKLKSDTRSAEEGGAAPAP

SEQ ID NO: 69281 - protein, 1090 aa, Homo sapiens
MATLLSHPQQRPPFLRQAIKIRRRRVRDLQDPPPQMAPEIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILEFEDITNASFHLDMWDLDTVESVRQKLGELTDLHGLRRIFKEARKDKGQDDFLGNVVLRLQDLRCREDQWYPLEPRTETYPDRGQCHLQFQLIHKRRATSASRSQPSYTVHLHLLQQLVSHEVTQHEAGSTSWDGSLSPQAATVLFLHATQKDLSDFHQSMAQWLAYSRLYQSLEFPSSCLLHPITSIEYQWIQGRLKAEQQEELAASFSSLLTYGLSLIRRFRSVFPLSVSDSPARLQSLLRVLVQMCKMKAFGELCPNTAPLPQLVTEALQTGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAVQMDELVPLGELTKHSTSAVDLSTCFAQISHTARQLDWPDPEEAFMITVKFVEDTCRLALVYCSLIKARARELSSGQKDQGQAANMLCVVVNDMEQLRLVIGKLPAQLAWEALEQRVGAVLEQGQLQNTLHAQLQSALAGLGHEIRTGVRTLAEQLEVGIAKHIQKLVGVRESVLPEDAILPLMKFLEVELCYMNTNLVQENFSSLLTLLWTHTLTVLVEAAASQRSSSLASNRLKIALQNLEICFHAEGCGLPPKALHTATFQALQRDLELQAASSRELIRKYFCSRIQQQAETTSEELGAVTVKASYRASEQKLRVELLSASSLLPLDSNGSSDPFVQLTLEPRHEFPELAARETQKHKKDLHPLFDETFEFLVPAEPCRKAGACLLLTVLDYDTLGADDLEGEAFLPLREVPGLSGSEEPGEVPQTRLPLTYPAPNGDPILQLLEGRKGDREAQVFVRLRRHRAKQASQHALRPAP

SEQ ID NO: 69282 - protein, 1142 aa, Homo sapiens
MATLLSHPQQRPPFLRQAIKIRRRRVRDLQDPPPQMAPEIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILEFEDITNASFHLDMWDLDTVESVRQKLGELTDLHGLRRIFKEARKDKGQDDFLGNVVLRLQDLRCREDQWYPLEPRTETYPDRGQCHLQFQLIHKRRATSASRSQPSYTVHLHLLQQLVSHEVTQHEAGSTSWDGSLSPQAATVLFLHATQKDLSDFHQSMAQWLAYSRLYQSLEFPSSCLLHPITSIEYQWIQGRLKAEQQEELAASFSSLLTYGLSLIRRFRSVFPLSVSDSPARLQSLLRVLVQMCKMKAFGELCPNTAPLPQLVTEALQTGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAVQMDELVPLGELTKHSTSAVDLSTCFAQISHTARQLDWPDPEEAFMITVKFVEDTCRLALVYCSLIKARARELSSGQKDQGQAANMLCVVVNDMEQLRLVIGKLPAQLAWEALEQRVGAVLEQGQLQNTLHAQLQSALAGLGHEIRTGVRTLAEQLEVGIAKHIQKLVGVRESVLPEDAILPLMKFLEVELCYMNTNLVQENFSSLLTLLWTHTLTVLVEAAASQRSSSLASNRLKIALQNLEICFHAEGCGLPPKALHTATFQALQRDLELQAASSRELIRKYFCSRIQQQAETTSEELGAVTVKASYRASEQKLRVELLSASSLLPLDSNGSSDPFVQLTLEPRHEFPELAARETQKHKKDLHPLFDETFEFLVPAEPCRKAGACLLLTVLDYDTLGADDLEGEAFLPLREVPGLSGSEEPGEVPQTRLPLTYPAPNGDPILQLLEGRKGDREAQVFVRLRRHRAKQGIGPSVSWPWPICLLAFLFQPLGWGPGSLGPGLQAQSLLEKGEGTLPKMRLQLPWGEGGGHY

SEQ ID NO: 69283 - protein, 944 aa, Homo sapiens
MATLLSHPQQRPPFLRQAIKIRRRRVRDLQDPPPQMAPEIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILEFEDITNASFHLDMWDLDTVESVRQKLGELTDLHGLRRIFKEARKDKGQDDFLGNVVLRLQDLRCREDQWYPLEPRTETYPDRGQCHLQFQLIHKRRATSASRSQPSYTVHLHLLQQLVSHEVTQHEAGSTSWDGSLSPQAATVLFLHATQKDLSDFHQSMAQWLAYSRLYQSLEFPSSCLLHPITSIEYQWIQGRLKAEQQEELAASFSSLLTYGLSLIRRFRSVFPLSVSDSPARLQSLLRVLVQMCKMKAFGELCPNTAPLPQLVTEALQTGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAVQMDELVPLGELTKHSTSAVDLSTCFAQISHTARQLDWPDPEEAFMITVKFVEDTCRLALVYCSLIKARARELSSGQKDQGQAANMLCVVVNDMEQLRLVIGKLPAQLAWEALEQRVGAVLEQGQLQNTLHAQLQSALAGLGHEIRTGVRTLAEQLEVGIAKHIQKLVGVRESVLPEDAILPLMKFLEVELCYMNTNLVQENFSSLLTLLWTHTLTVLVEAAASQRSSSLASNRLKIALQNLEICFHAEGCGLPPKTLPLPASQKSCCGGQGIGPSVSWPWPICLLAFLFQPLGWGPGSLGPGLQAQSLLEKGEGTLPKMRLQLPWGEGGGHY

SEQ ID NO: 69284 - protein, 929 aa, Homo sapiens
MTASSVEQLRKEGNELFKCGDYGGALAAYTQALGLDATPQDQAVLHRNRAACHLKLEDYDKAETEASKAIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 69285 - protein, 944 aa, Homo sapiens
MTVSGPGTPEPRPATPGASSVEQLRKEGNELFKCGDYGGALAAYTQALGLDATPQDQAVLHRNRAACHLKLEDYDKAETEASKAIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 69286 - protein, 802 aa, Homo sapiens
MAGTSERSLISSISQPKAIECFEVKKKAFLTHGRYHGSGATPPKTKDPKPETFCGQTGLPTMEVRINVSRQQVEKVFGLEEYWCQCVAWSSSGTTKSQKAYIRIAYLRKNFEQEPLAKEVSLEQGIVLPCRPPEGIPPAEVEWLRNEDLVDPSLDPNVYITREHSLVVRQARLADTANYTCVAKNIVARRRSASAAVIVYVDGSWSPWSKWSACGLDCTHWRSRECSDPAPRNGGEECQGTDLDTRNCTSDLCVHTASGPEDVALYVGLIAVAVCLVLLLLVLILVYCRKKEGLDSDVADSSILTSGFQPVSIKPSKADNPHLLTIQPDLSTTTTTYQGSLCPRQDGPSPKFQLTNGHLLSPLGGGRHTLHHSSPTSEAEEFVSRLSTQNYFRSLPRGTSNMTYGTFNFLGGRLMIPNTGISLLIPPDAIPRGKIYEIYLTLHKPEDVRLPLAGCQTLLSPIVSCGPPGVLLTRPVILAMDHCGEPSPDSWSLRLKKQSCEGSWEDVLHLGEEAPSHLYYCQLEASACYVFTEQLGRFALVGEALSVAAAKRLKLLLFAPVACTSLEYNIRVYCLHDTHDALKEVVQLEKQLGGQLIQEPRVLHFKDSYHNLRLSIHDVPSSLWKSKLLVSYQEIPFYHIWNGTQRYLHCTFTLERVSPSTSDLACKLWVWQVEGDGQSFSINFNITKDTRFAELLALESEAGVPALVGPSAFKIPFLIRQKIISSLDPPCRRGADWRTLAQKLHLDSHLSFFASKPSPTAMILNLWEARHFPNGNLSQLAAAVAGLGQPDAGLFTVSEAEC

SEQ ID NO: 69287 - protein, 842 aa, Homo sapiens
MAVRPGLWPALLGIVLAAWLRGSGAQQSATVANPVPGANPDLLPHFLVEPEDVYIVKNKPVLLVCKAVPATQIFFKCNGEWVRQVDHVIERSTDGSSGLPTMEVRINVSRQQVEKVFGLEEYWCQCVAWSSSGTTKSQKAYIRIAYLRKNFEQEPLAKEVSLEQGIVLPCRPPEGIPPAEVEWLRNEDLVDPSLDPNVYITREHSLVVRQARLADTANYTCVAKNIVARRRSASAAVIVYVDGSWSPWSKWSACGLDCTHWRSRECSDPAPRNGGEECQGTDLDTRNCTSDLCVHTASGPEDVALYVGLIAVAVCLVLLLLVLILVYCRKKEGLDSDVADSSILTSGFQPVSIKPSKADNPHLLTIQPDLSTTTTTYQGSLCPRQDGPSPKFQLTNGHLLSPLGGGRHTLHHSSPTSEAEEFVSRLSTQNYFRSLPRGTSNMTYGTFNFLGGRLMIPNTGISLLIPPDAIPRGKIYEIYLTLHKPEDVRLPLAGCQTLLSPIVSCGPPGVLLTRPVILAMDHCGEPSPDSWSLRLKKQSCEGSWEDVLHLGEEAPSHLYYCQLEASACYVFTEQLGRFALVGEALSVAAAKRLKLLLFAPVACTSLEYNIRVYCLHDTHDALKEVVQLEKQLGGQLIQEPRVLHFKDSYHNLRLSIHDVPSSLWKSKLLVSYQEIPFYHIWNGTQRYLHCTFTLERVSPSTSDLACKLWVWQVEGDGQSFSINFNITKDTRFAELLALESEAGVPALVGPSAFKIPFLIRQKIISSLDPPCRRGADWRTLAQKLHLDSHLSFFASKPSPTAMILNLWEARHFPNGNLSQLAAAVAGLGQPDAGLFTVSEAEC

SEQ ID NO: 69288 - protein, 945 aa, Homo sapiens
MGARSGARGALLLALLLCWDPRLSQAGTDSGSEVLPDSFPSAPAEPLPYFLQEPQDAYIVKNKPVELRCRAFPATQIYFKCNGEWVSQNDHVTQEGLDEATGLRVREVQIEVSRQQVEELFGLEDYWCQCVAWSSAGTTKSRRAYVRIAYLRKNFDQEPLGKEVPLDHEVLLQCRPPEGVPVAEVEWLKNEDVIDPTQDTNFLLTIDHNLIIRQARLSDTANYTCVAKNIVAKRRSTTATVIVYVNGGWSSWAEWSPCSNRCGRGWQKRTRTCTNPAPLNGGAFCEGQAFQKTACTTICPVDGAWTEWSKWSACSTECAHWRSRECMAPPPQNGGRDCSGTLLDSKNCTDGLCMQNKKTLSDPNSHLLEASGDAALYAGLVVAIFVVVAILMAVGVVVYRRNCRDFDTDITDSSAALTGGFHPVNFKTARPSNPQLLHPSVPPDLTASAGIYRGPVYALQDSTDKIPMTNSPLLDPLPSLKVKVYSSSTTGSGPGLADGADLLGVLPPGTYPSDFARDTHFLHLRSASLGSQQLLGLPRDPGSSVSGTFGCLGGRLSIPGTGVSLLVPNGAIPQGKFYEMYLLINKAESTLPLSEGTQTVLSPSVTCGPTGLLLCRPVILTMPHCAEVSARDWIFQLKTQAHQGHWEEVVTLDEETLNTPCYCQLEPRACHILLDQLGTYVFTGESYSRSAVKRLQLAVFAPALCTSLEYSLRVYCLEDTPVALKEVLELERTLGGYLVEEPKPLMFKDSYHNLRLSLHDLPHAHWRSKLLAKYQEIPFYHIWSGSQKALHCTFTLERHSLASTELTCKICVRQVEGEGQIFQLHTTLAETPAGSLDTLCSAPGSTVTTQLGPYAFKIPLSIRQKICNSLDAPNSRGNDWRMLAQKLSMDRYLNYFATKASPTGVILDLWEALQQDDGDLNSLASALEEMGKSEMLVAVATDGDC

SEQ ID NO: 69289 - protein, 934 aa, Homo sapiens
MGARSGARGALLLALLLCWDPRLSQAGTDSGSEVLPDSFPSAPAEPLPYFLQEPQDAYIVKNKPVELRCRAFPATQIYFKCNGEWVSQNDHVTQEGLDEATGLRVREVQIEVSRQQVEELFGLEDYWCQCVAWSSAGTTKSRRAYVRIAYLRKNFDQEPLGKEVPLDHEVLLQCRPPEGVPVAEVEWLKNEDVIDPTQDTNFLLTIDHNLIIRQARLSDTANYTCVAKNIVAKRRSTTATVIVYVNGGWSSWAEWSPCSNRCGRGWQKRTRTCTNPAPLNGGAFCEGQAFQKTACTTICPVDGAWTEWSKWSACSTECAHWRSRECMAPPPQNGGRDCSGTLLDSKNCTDGLCMQMLEASGDAALYAGLVVAIFVVVAILMAVGVVVYRRNCRDFDTDITDSSAALTGGFHPVNFKTARPSNPQLLHPSVPPDLTASAGIYRGPVYALQDSTDKIPMTNSPLLDPLPSLKVKVYSSSTTGSGPGLADGADLLGVLPPGTYPSDFARDTHFLHLRSASLGSQQLLGLPRDPGSSVSGTFGCLGGRLSIPGTGVSLLVPNGAIPQGKFYEMYLLINKAESTLPLSEGTQTVLSPSVTCGPTGLLLCRPVILTMPHCAEVSARDWIFQLKTQAHQGHWEEVVTLDEETLNTPCYCQLEPRACHILLDQLGTYVFTGESYSRSAVKRLQLAVFAPALCTSLEYSLRVYCLEDTPVALKEVLELERTLGGYLVEEPKPLMFKDSYHNLRLSLHDLPHAHWRSKLLAKYQEIPFYHIWSGSQKALHCTFTLERHSLASTELTCKICVRQVEGEGQIFQLHTTLAETPAGSLDTLCSAPGSTVTTQLGPYAFKIPLSIRQKICNSLDAPNSRGNDWRMLAQKLSMDRYLNYFATKASPTGVILDLWEALQQDDGDLNSLASALEEMGKSEMLVAVATDGDC

SEQ ID NO: 69290 - protein, 890 aa, Homo sapiens
DDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQTAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMRPPMDDSQTLLTPVVSCGPPGALLTRPVVLTMHHCADPNTEDWKILLKNQAAQGQWEDVVVVGEENFTTPCYIQLDAEACHILTENLSTYALVGHSTTKAAAKRLKLAIFGPLCCSSLEYSIRVYCLDDTQDALKEILHLERQMGGQLLEEPKALHFKGSTHNLRLSIHDIAHSLWKSKLLAKYQEIPFYHVWSGSQRNLHCTFTLERFSLNTVELVCKLCVRQVEGEGQIFQLNCTVSEEPTGIDLPLLDPANTITTVTGPSAFSIPLPIRQKLCSSLDAPQTRGHDWRMLAHKLNLDRYLNYFATKSSPTGVILDLWEAQNFPDGNLSMLAAVLEEMGRHETVVSLAAEGQY

SEQ ID NO: 69291 - protein, 931 aa, Homo sapiens
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQTAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMRPPMDDSQTLLTPVVSCGPPGALLTRPVVLTMHHCADPNTEDWKILLKNQAAQGQWEDVVVVGEENFTTPCYIQLDAEACHILTENLSTYALVGHSTTKAAAKRLKLAIFGPLCCSSLEYSIRVYCLDDTQDALKEILHLERQMGGQLLEEPKALHFKGSTHNLRLSIHDIAHSLWKSKLLAKYQEIPFYHVWSGSQRNLHCTFTLERFSLNTVELVCKLCVRQVEGEGQIFQLNCTVSEEPTGIDLPLLDPANTITTVTGPSAFSIPLPIRQKLCSSLDAPQTRGHDWRMLAHKLNLDRYLNYFATKSSPTGVILDLWEAQNFPDGNLSMLAAVLEEMGRHETVVSLAAEGQY

SEQ ID NO: 69292 - protein, 1050 aa, Homo sapiens
MEPGRGGTETVGKFEFSRKDLIGHGAFAVVFKGRHREKHDLEVAVKCINKKNLAKSQTLLGKEIKILKELKHENIVALYDFQEMANSVYLVMEYCNGGDLADYLHAMRTLSEDTIRLFLQQIAGAMRLLHSKGIIHRDLKPQNILLSNPAGRRANPNSIRVKIADFGFARYLQSNMMAATLCGSPMYMAPEVIMSQHYDGKADLWSIGTIVYQCLTGKAPFQASSPQDLRLFYEKNKTLVPTIPRETSAPLRQLLLALLQRNHKDRMDFDEFFHHPFLDASPSVRKSPPVPVPSYPSSGSGSSSSSSSTSHLASPPSLGEMQQLQKTLASPADTAGFLHSSRDSGGSKDSSCDTDDFVMVPAQFPGDLVAEAPSAKPPPDSLMCSGSSLVASAGLESHGRTPSPSPPCSSSPSPSGRAGPFSSSRCGASVPIPVPTQVQNYQRIERNLQSPTQFQTPRSSAIRRSGSTSPLGFARASPSPPAHAEHGGVLARKMSLGGGRPYTPSPQVGTIPERPGWSGTPSPQGAEMRGGRSPRPGSSAPEHSPRTSGLGCRLHSAPNLSDLHVVRPKLPKPPTDPLGAVFSPPQASPPQPSHGLQSCRNLRGSPKLPDFLQRNPLPPILGSPTKAVPSFDFPKTPSSQNLLALLARQGVVMTPPRNRTLPDLSEVGPFHGQPLGPGLRPGEDPKGPFGRSFSTSRLTDLLLKAAFGTQAPDPGSTESLQEKPMEIAPSAGFGGSLHPGARAGGTSSPSPVVFTVGSPPSGSTPPQGPRTRMFSAGPTGSASSSARHLVPGPCSEAPAPELPAPGHGCSFADPITANLEGAVTFEAPDLPEETLMEQEHTEILRGLRFTLLFVQHVLEIAALKGSASEAAGGPEYQLQESVVADQISLLSREWGFAEQLVLYLKVAELLSSGLQSAIDQIRAGKLCLSSTVKQVVRRLNELYKASVVSCQGLSLRLQRFFLDKQRLLDRIHSITAERLIFSHAVQMVQSAALDEMFQHREGCVPRYHKALLLLEGLQHMLSDQADIENVTKCKLCIERRLSALLTGICA

SEQ ID NO: 69293 - protein, 483 aa, Homo sapiens
MQRNGSASRGLEKTRLRLCREARIPESAFLTGLTRESWEARCWCAKDTREVVAIKCVAKKSLNKASVENLLTEIEILKGIRHPHIVQLKDFQWDSDNIYLIMEFCAGGDLSRFIHTRRILPEKVARVFMQQLASALQFLHERNISHLDLKPQNILLSSLEKPHLKLADFGFAQHMSPWDEKHVLRGSPLYMAPEMVCQRQYDARVDLWSMGVILYEALFGQPPFASRSFSELEEKIRSNRVIELPLRPLLSRDCRDLLQRLLERDPSRRISFQDFFAHPWVDLEHMPSGESLGRATALVVQAVKKDQEGDSAAALSLYCKALDFFVPALHYEVDAQRKEAIKAKVGQYVSRAEELKAIVSSSNQALLRQGTSARDLLREMARDKPRLLAALEVASAAMAKEEAAGGEQDALDLYQHSLGELLLLLAAEPPGRRRELLHTEVQNLMARAEYLKEQVKMRESRWEADTLDKEGLSESVRSSCTLQ

SEQ ID NO: 69294 - protein, 472 aa, Homo sapiens
MAGPGWGPPRLDGFILTERLGSGTYATVYKAYAKKDTREVVAIKCVAKKSLNKASVENLLTEIEILKGIRHPHIVQLKDFQWDSDNIYLIMEFCAGGDLSRFIHTRRILPEKVARVFMQQLASALQFLHERNISHLDLKPQNILLSSLEKPHLKLADFGFAQHMSPWDEKHVLRGSPLYMAPEMVCQRQYDARVDLWSMGVILYEALFGQPPFASRSFSELEEKIRSNRVIELPLRPLLSRDCRDLLQRLLERDPSRRISFQDFFAHPWVDLEHMPSGESLGRATALVVQAVKKDQEGDSAAALSLYCKALDFFVPALHYEVDAQRKEAIKAKVGQYVSRAEELKAIVSSSNQALLRQGTSARDLLREMARDKPRLLAALEVASAAMAKEEAAGGEQDALDLYQHSLGELLLLLAAEPPGRRRELLHTEVQNLMARAEYLKEQVKMRESRWEADTLDKEGLSESVRSSCTLQ

SEQ ID NO: 69295 - protein, 3234 aa, Homo sapiens
MVKRKSSEGQEQDGGRGIPLPIQTFLWRQTSAFLRPKLGKQYEASCVSFERVLVENKLHGLSPALSEAIQSISRWELVQAALPHVLHCTATLLSNRNKLGHQDKLGVAETKLLHTLHWMLLEAPQDCNNERFGGTDRGSSWGGSSSAFIHQVENQGSPGQPCQSSSNDEEENNRRKIFQNSMATVELFVFLFAPLVHRIKESDLTFRLASGLVIWQPMWEHRQPGVSGFTALVKPIRNIITAKRSSPINSQSRTCESPNQDARHLEGLQVVCETFQSDSISPKATISGCHRGNSFDGSLSSQTSQERGPSHSRASLVIPPCQRSRYATYFDVAVLRCLLQPHWSEEGTQWSLMYYLQRLRHMLEEKPEKPPEPDIPLLPRPRSSSMVAAAPSLVNTHKTQDLTMKCNEEEKSLSSEAFSKVSLTNLRRSAVPDLSSDLGMNIFKKFKSRKEDRERKGSIPFHHTGKRRPRRMGVPFLLHEDHLDVSPTRSTFSFGSFSGLGEDRRGIEKGGWQTTILGKLTRRGSSDAATEMESLSARHSHSHHTLVSDLPDPSNSHGENTVKEVRSQISTITVATFNTTLASFNVGYADFFNEHMRKLCNQVPIPEMPHEPLACANLPRSLTDSCINYSYLEDTEHIDGTNNFVHKNGMLDLSVVLKAVYLVLNHDISSRICDVALNIVECLLQLGVVPCVEKNRKKSENKENETLEKRPSEGAFQFKGVSGSSTCGFGGPAVSGAGDGGGEEGGGGDGGGGGGDGGGGGGGGGGPYEKNDKNQEKDESTPVSNHRLALTMLIKIVKSLGCAYGCGEGHRGLSGDRLRHQAQNCLTKLYKLDKMQFRQTMRDYVNKDSLNNVVDFLHALLGFCMEPVTDNKAGFGNNFTTVDNKSTAQNVEGIIVSAMFKSLITRCASTTHELHSPENLGLYCDIRQLVQFIKEAHGNVFRRVALSALLDSAEKLAPGKKVEENEQESKPAGSKRSEAGSIVDKGQVSSAPEECRSFMSGRPSQTPEHDEQMQGANLGRKDFWRKMFKSQSAASDTSSQSEQDTSECTTAHSGTTSDRRARSRSRRISLRKKLKLPIGKRNWLKRSSLSGLADGVEDLLDISSVDRLSFIRQSSKVKFTSAVKLSEGGPGSGMENGRDEEENFFKRLGCHSFDDHLSPNQDGGKSKNVVNLGAIRQGMKRFQFLLNCCEPGTIPDASILAAALDLEAPVVARAALFLECARFVHRCNRGNWPEWMKGHHVNITKKGLSRGRSPIVGNKRNQKLQWNAAKLFYQWGDAIGVRLNELCHGESESPANLLGLIYDEETKRRLRKEDEEEDFLDDSTVNPSKCGCPFALKMAACQLLLEITTFLRETFSCLPRPRTEPLVDLESCRLRLDPELDRHRYERKISFAGVLDENEDSKDSLHSSSHTLKSDAGVEEKKEGSPWSASEPSIEPEGMSNAGAEENYHRNMSWLHVMILLCNQQSFICTHVDYCHPHCYLHHSRSCARLVRAIKLLYGDSVDSLRESSNISSVALRGKKQKECSDKSCLRTPSLKKRVSDANLEGKKDSGMLKYIRLQVMSLSPAPLSLLIKAAPILTEEMYGDIQPAAWELLLSMDEHMAGAAAAMFLLCAVKVPEAVSDMLMSEFHHPETVQRLNAVLKFHTLWRFRYQVWPRMEEGAQQIFKIPPPSINFTLPSPVLGMPSVPMFDPPWVPQCSGSVQDPINEDQSKSFSARAVSRSHQRAEHILKNLQQEEEKKRLGREASLITAIPITQEACYEPTCTPNSEPEEEVEEVTNLASRRLSVSPSCTSSTSHRNYSFRRGSVWSVRSAVSAEDEEHTTEHTPNHHVPQPPQAVFPACICAAVLPIVHLMEDGEVREDGVAVSAVAQQVLWNCLIEDPSTVLRHFLEKLTISNRQDELMYMLRKLLLNIGDFPAQTSHILFNYLVGLIMYFVRTPCEWGMDAISATLTFLWEVVGYVEGLFFKDLKQTMKKEQCEVKLLVTASMPGTKTLVVHGQNECDIPTQLPVHEDTQFEALLKECLEFFNIPESQSTHYFLMDKRWNLIHYNKTYVRDIYPFRRSVSPQLNLVHMHPEKGQELIQKQVFTRKLEEVGRVLFLISLTQKIPTAHKQSHVSMLQEDLLRLPSFPRSAIDAEFSLFSDPQAGKELFGLDTLQKSLWIQLLEEMFLGMPSEFPWGDEIMLFLNVFNGALILHPEDSALLRQYAATVINTAVHFNHLFSLSGYQWILPTMLQVYSDYESNPQLRQAIEFACHQFYILHRKPFVLQLFASVAPLLEFPDAANNGPSKGVSAQCLFDLLQSLEGETTDILDILELVKAEKPLKSLDFCYGNEDLTFSISEAIKLCVTVVAYAPESFRSLQMLMVLEALVPCYLQKLKRQTSQVETVPAAREEIAATAALATSLQALLYSVEVLTRPMTAPQMSRCDQGHKGTTTANHTMSSGVNTRYQEQGAKLHFIRENLHLLEEGQGIPREELDERIAREEFRRPRESLLNICTEFYKHCGPRLKILQNLAGEPRVIALELLDVKSHMRLAEIAHSLLKLAPYDTQTMESRGLRRYIMEMLPITDWTAEAVRPALILILKRLDRMFNKIHKMPTLRRQVEWEPASNLIEGVCLTLQRQPIISFLPHLRSLINVCVNLVMGVVGPSSVADGLPLLHLSPYLSPPLPFSTAVVRLVALQIQALKEDFPLSHVISPFTNQERREGMLLNLLIPFVLTVGSGSKDSPWLEQPEVQLLLQTVINVLLPPRIISTSRSKNFMLESSPAHCSTPGDAGKDLRREGLAESTSQAAYLALKVILVCFERQLGSQWYWLSLQVKEMALRKVGGLALWDFLDFIVRTRIPIFVLLRPFIQCKLLAQPAENHEELSARQHIADQLERRFIPRPLCKSSLIAEFNSELKILKEAVHSGSAYQGKTSISTVGTSTSAYRLSLATMSRSNTGTGTVWEQDSEPSQQASQDTLSRTDEEDEENDSISMPSVVSEQEAYLLSAIGRRRFSSHVSSMSVPQAEVGMLPSQRVASIQSEPGQQNLLVQQPLGRKRGLRQLRRPLLSRQKTQTEPRNRQGARLSTTRRSIQPKTKPSADQKRSVTFIEAQPEPAAAPTDALPATGQLQGCSPAPSRKPEAMDEPVLTSSPAIVVADLHSVSPKQSENFPTEEGEKEEDTEAQGATAHSPLSAQLSDPDDFTGLETSSLLQHGDTVLHISEENGMENPLLSSQFTFTPTELGKTDAVLDESHV

SEQ ID NO: 69296 - protein, 3258 aa, Homo sapiens
MVKRKSSEGQEQDGGRGIPLPIQTFLWRQTSAFLRPKLGKQYEASCVSFERVLVENKLHGLSPALSEAIQSISRWELVQAALPHVLHCTATLLSNRNKLGHQDKLGVAETKLLHTLHWMLLEAPQDCNNERFGGTDRGSSWGGSSSAFIHQVENQGSPGQPCQSSSNDEEENNRRKIFQNSMATVELFVFLFAPLVHRIKESDLTFRLASGLVIWQPMWEHRQPGVSGFTALVKPIRNIITAKRSSPINSQSRTCESPNQDARHLEGLQVVCETFQSDSISPKATISGCHRGNSFDGSLSSQTSQERGPSHSRASLVIPPCQRSRYATYFDVAVLRCLLQPHWSEEGTQWSLMYYLQRLRHMLEEKPEKPPEPDIPLLPRPRSSSMVAAAPSLVNTHKTQDLTMKCNEEEKSLSSEAFSKVSLTNLRRSAVPDLSSDLGMNIFKKFKSRKEDRERKGSIPFHHTGKRRPRRMGVPFLLHEDHLDVSPTRSTFSFGSFSGLGEDRRGIEKGGWQTTILGKLTRRGSSDAATEMESLSARHSHSHHTLVSDLPDPSNSHGENTVKEVRSQISTITVATFNTTLASFNVGYADFFNEHMRKLCNQVPIPEMPHEPLACANLPRSLTDSCINYSYLEDTEHIDGTNNFVHKNGMLDLSVVLKAVYLVLNHDISSRICDVALNIVECLLQLGVVPCVEKNRKKSENKENETLEKRPSEGAFQFKGVSGSSTCGFGGPAVSGAGDGGGEEGGGGDGGGGGGDGGGGGGGGGGPYEKNDKNQEKDESTPVSNHRLALTMLIKIVKSLGCAYGCGEGHRGLSGDRLRHQVFRENAQNCLTKLYKLDKMQFRQTMRDYVNKDSLNNVVDFLHALLGFCMEPVTDNKAGFGNNFTTVDNKSTAQNVEGIIVSAMFKSLITRCASTTHELHSPENLGLYCDIRQLVQFIKEAHGNVFRRVALSALLDSAEKLAPGKKVEENEQESKPAGSKRSEAGSIVDKGQVSSAPEECRSFMSGRPSQTPEHDEQMQGANLGRKDFWRKMFKSQSAASDTSSQSEQDTSECTTAHSGTTSDRRARSRSRRISLRKKLKLPIGKRNWLKRSSLSGLADGVEDLLDISSVDRLSFIRQSSKVKFTSAVKLSEGGPGSGMENGRDEEENFFKRLGCHSFDDHLSPNQDGGKSKNVVNLGAIRQGMKRFQFLLNCCEPGTIPDASILAAALDLEAPVVARAALFLECARFVHRCNRGNWPEWMKGHHVNITKKGLSRGRSPIVGNKRNQKLQWNAAKLFYQWGDAIGVRLNELCHGESESPANLLGLIYDEETKRRLRKEDEEEDFLDDSTVNPSKCGCPFALKMAACQLLLEITTFLRETFSCLPRPRTEPLVDLESCRLRLDPELDRHRYERKISFAGVLDENEDSKDSLHSSSHTLKSDAGVEEKKEGSPWSASEPSIEPEGMSNAGAEENYHRNMSWLHVMILLCNQQSFICTHVDYCHPHCYLHHSRSCARLVRAIKLLYGDSVDSLRESSNISSVALRGKKQKECSDKSCLRTPSLKKRVSDANLEGKKDSGMLKYIRLQVMSLSPAPLSLLIKAAPILTEEMYGDIQPAAWELLLSMDEHMAGAAAAMFLLCAVKVPEAVSDMLMSEFHHPETVQRLNAVLKFHTLWRFRYQVWPRMEEGAQQIFKIPPPSINFTLPSPVLGMPSVPMFDPPWVPQCSGSVQDPINEDQSKSFSARAVSRSHQRAEHILKNLQQEEEKKRLGREASLITAIPITQEACYEPTCTPNSEPEEEVEEVTNLASRRLSVSPSCTSSTSHRNYSFRRGSVWSVRSAVSAEDEEHTTEHTPNHHVPQPPQAVFPACICAAVLPIVHLMEDGEVREDGVAVSAVAQQVLWNCLIEDPSTVLRHFLEKLTISNRQDELMYMLRKLLLNIGDFPAQTSHILFNYLVGLIMYFVRTPCEWGMDAISATLTFLWEVVGYVEGLFFKDLKQTMKKEQCEVKLLVTASMPGTKTLVVHGQNECDIPTQLPVHEDTQFEALLKECLEFFNIPESQSTHYFLMDKRWNLIHYNKTYVRDIYPFRRSVSPQLNLVHMHPEKGQELIQKQVFTRKLEEVGRVLFLISLTQKIPTAHKQSHVSMLQEDLLRLPSFPRSAIDAEFSLFSDPQAGKELFGLDTLQKSLWIQLLEEMFLGMPSEFPWGDEIMLFLNVFNGALILHPEDSALLRQYAATVINTAVHFNHLFSLSGYQWILPTMLQVYSDYESNPQLRQAIEFACHQFYILHRKPFVLQLFASVAPLLEFPDAANNGPSKGVSAQCLFDLLQSLEGETTDILDILELVKAEKPLKSLDFCYGNEDLTFSISEAIKLCVTVVAYAPESFRSLQMLMVLEALVPCYLQKLKRQTSQVETVPAAREEIAATAALATSLQALLYSVEVLTRPMTAPQMSRCDQGHKGTTTANHTMSSGVNTRYQEQGAKLHFIRENLHLLEEGQGIPREELDERIAREEFRRPRESLLNICTEFYKHCGPRLKILQNLAGEPRVIALELLDVKSHMRLAEIAHSLLKLAPYDTQTMESRGLRRYIMEMLPITDWTAEAVRPALILILKRLDRMFNKIHKMPTLRRQVEWEPASNLIEGVCLTLQRQPIISFLPHLRSLINVCVNLVMGVVGPSSVADGLPLLHLSPYLSPPLPFSTAVVRLVALQIQALKEDFPLSHVISPFTNQERREGMLLNLLIPFVLTVGSGSKDSPWLEQPEVQLLLQTVINVLLPPRIISTSRSKNFMLESSPAHCSTPGDAGKDLRREGLAESTSQAAYLALKVILVCFERQLGSQWYWLSLQVKEMALRKVGGLALWDFLDFIVRTRIPIFVLLRPFIQCKLLAQPAENHEELSARQHIADQLERRFIPRPLCKSSLIAEFNSELKILKEAVHSGSAYQGKTSISTVGTSTSAYRLSLATMSRSNTGTGTVWEQDSEPSQQASQDTLSRTDEEDEENDSISMPSVVSEQEAYLLSAIGRRRFSSHVSSMSVPQAEVGMLPSQSEPNVLDDSQGLAAEGSLSRVASIQSEPGQQNLLVQQPLGRKRGLRQLRRPLLSRQKTQTEPRNRQGARLSTTRRSIQPKTKPSADQKRSVTFIEAQPEPAAAPTDALPATGQLQGCSPAPSRKPEAMDEPVLTSSPAIVVADLHSVSPKQSENFPTEEGEKEEDTEAQGATAHSPLSAQLSDPDDFTGLETSSLLQHGDTVLHISEENGMENPLLSSQFTFTPTELGKTDAVLDESHV

SEQ ID NO: 69297 - protein, 466 aa, Homo sapiens
MESRGLRRYIMEMLPITDWTAEAVRPALILILKRLDRMFNKIHKMPTLRRQVEWEPASNLIEGVCLTLQRQPIISFLPHLRSLINVCVNLVMGVVGPSSVADGLPLLHLSPYLSPPLPFSTAVVRLVALQIQALKEDFPLSHVISPFTNQERREGMLLNLLIPFVLTVGSGSKDSPWLEQPEVQLLLQTVINVLLPPRIISTSRSKNFMLESSPAHCSTPGDAGKDLRREGLAESTSQAAYLALKVILVCFERQLGSQWYWLSLQVKEMALRKVGGLALWDFLDFIVRTRIPIFVLLRPFIQCKLLAQPAENHEELSARQHIADQLERRFIPRPLCKSSLIAEFNSELKILKEAVHSGSAYQGKTSISTVGTSTSAYRLSLATMSRSNTGTGTVWEQDSEPSQQASQDTLSRTDEEDEENDSISMPSVVSEQEAYLLSAIGRRRFSSHVSSMSVPQAEVGMLPSQR

SEQ ID NO: 69298 - protein, 457 aa, Homo sapiens
MDRSLRNVLVVSFGFLLLFTAYGGLQSLQSSLYSEEGLGVTALSTLYGGMLLSSMFLPPLLIERLGCKGTIILSMCGYVAFSVGNFFASWYTLIPTSILLGLGAAPLWSAQCTYLTITGNTHAEKAGKRGKDMVNQYFGIFFLIFQSSGVWGNLISSLVFGQTPSQETLPEEQLTSCGASDCLMATTTTNSTQRPSQQLVYTLLGIYTGSGVLAVLMIAAFLQPIRDVQRESEGEKKSVPFWSTLLSTFKLYRDKRLCLLILLPLYSGLQQGFLSSEYTRSYVTCTLGIQFVGYVMICFSATDALCSVLYGKVSQYTGRAVLYVLGAVTHVSCMIALLLWRPRADHLAVFFVFSGLWGVADAVWQTQNNALYGVLFEKSKEAAFANYRLWEALGFVIAFGYSMFLCVHVKLYILLGVLSLTMVAYGLVECVESKNPIRPHAPGQVNQAEDEEIQTKM

SEQ ID NO: 69299 - protein, 415 aa, Homo sapiens
MDRSLRNVLVVSFGFLLLFTAYGGLQSLQSSLYSEEGLGVTALSTLYGGMLLSSMFLPPLLIERLGCKGTIILSMCGYVAFSVGNFFASWYTLIPTSILLGLGAAPLWSAQCTYLTITGNTHAEKAGKRGKDMVNQYFGIFFLIFQSSGVWGNLISSLVFGQTPSQGSGVLAVLMIAAFLQPIRDVQRESEGEKKSVPFWSTLLSTFKLYRDKRLCLLILLPLYSGLQQGFLSSEYTRSYVTCTLGIQFVGYVMICFSATDALCSVLYGKVSQYTGRAVLYVLGAVTHVSCMIALLLWRPRADHLAVFFVFSGLWGVADAVWQTQNNALYGVLFEKSKEAAFANYRLWEALGFVIAFGYSMFLCVHVKLYILLGVLSLTMVAYGLVECVESKNPIRPHAPGQVNQAEDEEIQTKM

SEQ ID NO: 69300 - protein, 144 aa, Homo sapiens
MDRSLRNVLVVSFGFLLLFTAYGGLQSLQSSLYSEEGLGVTALSTLYGGMLLSSMFLPPLLIERLGCKGTIILSMCGYVAFSVGNFFASWYTLIPTSILLGLGAAPLWSAQCTYLTITGNTHAEKAGKRGKDMVNQYFGIFFLI

SEQ ID NO: 69301 - protein, 596 aa, Homo sapiens
MEAEPPLYPMAGAAGPQGDEDLLGVPDGPEAPLDELVGAYPNYNEEEEERRYYRRKRLGVLKNVLAASAGGMLTYGVYLGLLQMQLILHYDETYREVKYGNMGLPDIDSKMLMGINVTPIAALLYTPVLIRFFGTKWMMFLAVGIYALFVSTNYWERYYTLVPSAVALGMAIVPLWASMGNYITRMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVFLAMLLVLGLCGAAYRPTEEIDLRSVGWGNIFQLPFKHVRDYRLRHLVPFFIYSGFEVLFACTGIALGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAAAVSYLRMEQKLRRGVAPRQPRIPRPQHKVRGYRYLEEDNSDESDAEGEHGDGAEEEAPPAGPRPGPEPAGLGRRPCPYEQAQGGDGPEEQ

SEQ ID NO: 69302 - protein, 307 aa, Homo sapiens
MGGLTASDVHPTLGVQLFSAGIAACLADVITFPLDTAKVRLQVQGECPTSSVIRYKGVLGTITAVVKTEGRMKLYSGLPAGLQRQISSASLRIGLYDTVQEFLTAGKETAPSLGSKILAGLTTGGVAVFIGQPTEVVKVRLQAQSHLHGIKPRYTGTYNAYRIIATTEGLTGLWKGTTPNLMRSVIINCTELVTYDLMKEAFVKNNILADDVPCHLVSALIAGFCATAMSSPVDVVKTRFINSPPGQYKSVPNCAMKVFTNEGPTAFFKGLVPSFLRLGSWNVIMFVCFEQLKRELSKSRQTMDCAT

SEQ ID NO: 69303 - protein, 309 aa, Homo sapiens
MVGFKATDVPPTATVKFLGAGTAACIADLITFPLDTAKVRLQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTDDLPCHFTSAFGAGFCTTVIASPVDVVKTRYMNSALGQYSSAGHCALTMLQKEGPRAFYKGFMPSFLRLGSWNVVMFVTYEQLKRALMAACTSREAPF

SEQ ID NO: 69304 - protein, 33 aa, Homo sapiens
MVGFKATDVPPTATVKFLGAGTAACIADLITFP

SEQ ID NO: 69305 - protein, 312 aa, Homo sapiens
MVGLKPSDVPPTMAVKFLGAGTAACFADLVTFPLDTAKVRLQIQGENQAVQTARLVQYRGVLGTILTMVRTEGPCSPYNGLVAGLQRQMSFASIRIGLYDSVKQVYTPKGADNSSLTTRILAGCTTGAMAVTCAQPTDVVKVRFQASIHLGPSRSDRKYSGTMDAYRTIAREEGVRGLWKGTLPNIMRNAIVNCAEVVTYDILKEKLLDYHLLTDNFPCHFVSAFGAGFCATVVASPVDVVKTRYMNSPPGQYFSPLDCMIKMVAQEGPTAFYKGFTPSFLRLGSWNVVMFVTYEQLKRALMKVQMLRESPF

SEQ ID NO: 69306 - protein, 210 aa, Homo sapiens
MVGLKPSDVPPTMAVKFLGAGTAACFADLVTFPLDTAKVRLQIQGENQAVQTARLVQYRGVLGTILTMVRTEGPCSPYNGLVAGLQRQMSFASIRIGLYDSVKQVYTPKGADNNFPCHFVSAFGAGFCATVVASPVDVVKTRYMNSPPGQYFSPLDCMIKMVAQEGPTAFYKGFTPSFLRLGSWNVVMFVTYEQLKRALMKVQMLRESPF

SEQ ID NO: 69307 - protein, 275 aa, Homo sapiens
MVGLKPSDVPPTMAVKFLGAGTAACFADLVTFPLDTAKVRLQIQGENQAVQTARLVQYRGVLGTILTMVRTEGPCSPYNGLVAGLQRQMSFASIRIGLYDSVKQVYTPKGADNSSLTTRILAGCTTGAMAVTCAQPTDVVKVRFQASIHLGPSRSDRKYSGTMDAYRTIAREEGVRGLWKGTLPNIMRNAIVNCAEVVTYDILKEKLLDYHLLTDNFPCHFVSAFGAGFCATVVASPVDVVKTRYMNSPPGQYFSPLDCMIKMVAQEGPTAFYKG

SEQ ID NO: 69308 - protein, 96 aa, Homo sapiens
MVGLKPSDVPPTMAVKFLGAGTAACFADLVTFPLDTAKVRLQIQGENQAVQTARLVQYRGVLGTILTMVRTEGPCSPYNGLVAGLQRQMSFASIRI

SEQ ID NO: 69309 - protein, 341 aa, Homo sapiens
MLLRPRRPPPLAPPAPPSPASPDPEPRTPGDAPGTPPRRPASPSALGELGLPVSPGSAQRTPWSARETELLLGTLLQPAVWRALLLDRRQALPTYRRVSAALAQQQVRRTPAQCRRRYKFLKDKFREAHGQPPGPFDEQIRKLMGLLGDNGRKRPRRRSPGSGRPQRARRPVPNAHAPAPSEPDATPLPTARDRDADPTWTLRFSPSPPKSADASPAPGSPPAPAPTALATCIPEDRAPVRGPGSPPPPPAREDPDSPPGRPEDCAPPPAAPPSLNTALLQTLGHLGDIANILGPLRDQLLTLNQHVEQLRGAFDQTVSLAVGFILGSAAAERGVLRDPCQ

SEQ ID NO: 69310 - protein, 1118 aa, Homo sapiens
MSVEAYGPSSQTLTFLDTEEAELLGADTQGSEFEFTDFTLPSQTQTPPGGPGGPGGGGAGGPGGAGAGAAAGQLDAQVGPEGILQNGAVDDSVAKTSQLLAELNFEEDEEDTYYTKDLPIHACSYCGIHDPACVVYCNTSKKWFCNGRGNTSGSHIVNHLVRAKCKEVTLHKDGPLGETVLECYNCGCRNVFLLGFIPAKADSVVVLLCRQPCASQSSLKDINWDSSQWQPLIQDRCFLSWLVKIPSEQEQLRARQITAQQINKLEELWKENPSATLEDLEKPGVDEEPQHVLLRYEDAYQYQNIFGPLVKLEADYDKKLKESQTQDNITVRWDLGLNKKRIAYFTLPKTDSDMRLMQGDEICLRYKGDLAPLWKGIGHVIKVPDNYGDEIAIELRSSVGAPVEVTHNFQVDFVWKSTSFDRMQSALKTFAVDETSVSGYIYHKLLGHEVEDVIIKCQLPKRFTAQGLPDLNHSQVYAVKTVLQRPLSLIQGPPGTGKTVTSATIVYHLARQGNGPVLVCAPSNIAVDQLTEKIHQTGLKVVRLCAKSREAIDSPVSFLALHNQIRNMDSMPELQKLQQLKDETGELSSADEKRYRALKRTAERELLMNADVICCTCVGAGDPRLAKMQFRSILIDESTQATEPECMVPVVLGAKQLILVGDHCQLGPVVMCKKAAKAGLSQSLFERLVVLGIRPIRLQVQYRMHPALSAFPSNIFYEGSLQNGVTAADRVKKGFDFQWPQPDKPMFFYVTQGQEEIASSGTSYLNRTEAANVEKITTKLLKAGAKPDQIGIITPYEGQRSYLVQYMQFSGSLHTKLYQEVEIASVDAFQGREKDFIILSCVRANEHQGIGFLNDPRRLNVALTRARYGVIIVGNPKALSKQPLWNHLLNYYKEQKVLVEGPLNNLRESLMQFSKPRKLVNTINPGARFMTTAMYDAREAIIPGSVYDRSSQGRPSSMYFQTHDQIGMISAGPSHVAAMNIPIPFNLVMPPMPPPGYFGQANGPAAGRGTPKGKTGRGGRQKNRFGLPGPSQTNLPNSQASQDVASQPFSQGALTQGYISMSQPSQMSQPGLSQPELSQDSYLGDEFKSQIDVALSQDSTYQGERAYQHGGVTGLSQY

SEQ ID NO: 69311 - protein, 579 aa, Homo sapiens
MPAERKKPASMEEKDSLPNNKEKDCSERRTVSSKERPKDDIKLTAKKEVSKAPEESKKKEEEEKKKHQEEERKKQEEQAKRQQEEEAAAQMKEKEESIQLHQEAWERHHLRKELRSKNQNAPDSRPEENFFSRLDSSLKKNTAFVKKLKTITEQQRDSLSHDFNGLNLSKYIAEAVASIVEAKLKISDVNCAVHLCSLFHQRYADFAPSLLQVWKKHFEARKEEKTPNITKLRTDLRFIAELTIVGIFTDKEGLSLIYEQLKNIINADRESHTHVSVVISFCRHCGDDIAGLVPRKVKSAAEKFNLSFPPSEIISPEKQQPFQNLLKEYFTSLTKHLKRDHRELQNTERQNRRILHSKGELSEDRHKQYEEFAMSYQKLLANSQSLADLLDENMPDLPQDKPTPEEHGPGIDIFTPGKPGEYDLEGGIWEDEDARNFYENLIDLKAFVPAILFKDNEKSCQNKESNKDDTKEAKESKENKEVSSPDDLELELENLEINDDTLELEGGDEAEDLTKKLLDEQEQEDEEASTGSHLKLIVDAFLQQLPNCVNRDLIDKAEKAFCNGNLARVNLLLRMAVKK

SEQ ID NO: 69312 - protein, 1272 aa, Homo sapiens
MPAERKKPASMEEKDSLPNNKEKDCSERRTVSSKERPKDDIKLTAKKEVSKAPEDKKKRLEDDKRKKEDKERKKKDEEKVKAEEESKKKEEEEKKKHQEEERKKQEEQAKRQQEEEAAAQMKEKEESIQLHQEAWERHHLRKELRSKNQNAPDSRPEENFFSRLDSSLKKNTAFVKKLKTITEQQRDSLSHDFNGLNLSKYIAEAVASIVEAKLKISDVNCAVHLCSLFHQRYADFAPSLLQVWKKHFEARKEEKTPNITKLRTDLRFIAELTIVGIFTDKEGLSLIYEQLKNIINADRESHTHVSVVISFCRHCGDDIAGLVPRKVKSAAEKFNLSFPPSEIISPEKQQPFQNLLKEYFTSLTKHLKRDHRELQNTERQNRRILHSKGELSEDRHKQYEEFAMSYQKLLANSQSLADLLDENMPDLPQDKPTPEEHGPGIDIFTPGKPGEYDLEGGIWEDEDARNFYENLIDLKAFVPAILFKDNEKSCQNKESNKDDTKEAKESKENKEVSSPDDLELELENLEINDDTLELEGGDEAEDLTKKLLDEQEQEDEEASTGSHLKLIVDAFLQQLPNCVNRDLIDKAAMDFCMNMNTKANRKKLVRALFIVPRQRLDLLPFYARLVATLHPCMSDVAEDLCSMLRGDFRFHVRKKDQINIETKNKTVRFIGELTKFKMFTKNDTLHCLKMLLSDFSHHHIEMACTLLETCGRFLFRSPESHLRTSVLLEQMMRKKQAMHLDARYVTMVENAYYYCNPPPAEKTVKKKRPPLQEYVRKLLYKDLSKVTTEKVLRQMRKLPWQDQEVKDYVICCMINIWNVKYNSIHCVANLLAGLVLYQEDVGIHVVDGVLEDIRLGMEVNQPKFNQRRISSAKFLGELYNYRMVESAVIFRTLYSFTSFGVNPDGSPSSLDPPEHLFRIRLVCTILDTCGQYFDRGSSKRKLDCFLVYFQRYVWWKKSLEVWTKDHPFPIDIDYMISDTLELLRPKIKLCNSLEESIRQVQDLEREFLIKLGLVNDKDSKDSMTEGENLEEDEEEEEGGAETEEQSGNESEVNEPEEEEGSDNDDDEGEEEEEENTDYLTDSNKENETDEENTEVMIKGGGLKHVPCVEDEDFIQALDKMMLENLQQRSGESVKVHQLDVAIPLHLKSQLRKGPPLGGGEGEAESADTMPFVMLTRKGNKQQFKILNVPMSSQLAANHWNQQQAEQEERMRMKKLTLDINERQEQEDYQEMLQSLAQRPAPANTNRERRPRYQHPKGAPNADLIFKTGGRRR

SEQ ID NO: 69313 - protein, 1272 aa, Homo sapiens; identical to SEQ ID NO: 69312

SEQ ID NO: 69314 - protein, 124 aa, Homo sapiens
MIKGGGLKHVPCVEDEDFIQALDKMMLENLQQRSGESVKVHQLDVAIPLHLKSQLRKGPPLGGGEGEAESADTMPFVMLTRKGNKQQFKILNVPMSSQLAANHWNQQQAERREDENEKAHTRYQ

SEQ ID NO: 69315 - protein, 579 aa, Homo sapiens; identical to SEQ ID NO: 69311

SEQ ID NO: 69316 - protein, 1272 aa, Homo sapiens; identical to SEQ ID NO: 69312

SEQ ID NO: 69317 - protein, 443 aa, Homo sapiens
MRSEKEGAGGLRAAVAARGPSGREKLSALEVQFHRDSQQQEAETPPTSSSGCGGGAGKPREEKRTALSKVVIRRLPPGLTKEQLEEQLRPLPAHDYFEFFAADLSLYPHLYSRAYINFRNPDDILLFRDRFDGYIFLDSKDPEYKKFLETYCVEEEKTSANPETLLGEMEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKDRPALQLYDPGARFRARECGGNRRICKAEGSGTGPEKREEAE

SEQ ID NO: 69318 - protein, 476 aa, Homo sapiens
MRSEKEGAGGLRAAVAARGPSGREKLSALEVQFHRDSQQQEAETPPTSSSGCGGGAGKPREEKRTALSKVVIRRLPPGLTKEQLEEQLRPLPAHDYFEFFAADLSLYPHLYSRAYINFRNPDDILLFRDRFDGYIFLDSKGLEYPAVVEFAPFQKIAKKKLRKKDAKTGSIEDDPEYKKFLETYCVEEEKTSANPETLLGEMEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKDRPALQLYDPGARFRARECGGNRRICKAEGSGTGPEKREEAE

SEQ ID NO: 69319 - protein, 208 aa, Homo sapiens
MEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAPRKERLANKDRPALQLYDPGARFRARECGGNRRICKAEGSGTGPEKREEAE

SEQ ID NO: 69320 - protein, 483 aa, Homo sapiens
MKEEKEHRPKEKRVTLLTPAGATGSGGGTSGDSSKGEDKQDRNKEKKEALSKVVIRRLPPTLTKEQLQEHLQPMPEHDYFEFFSNDTSLYPHMYARAYINFKNQEDIILFRDRFDGYVFLDNKGQEYPAIVEFAPFQKAAKKKTKKRDTKVGTIDDDPEYRKFLESYATDNEKMTSTPETLLEEIEAKNRELIAKKTTPLLSFLKNKQRMREEKREERRRREIERKRQREEERRKWKEEEKRKRKDIEKLKKIDRIPERDKLKDEPKIKVHRFLLQAVNQKNLLKKPEKGDEKELDKREKAKKLDKENLSDERASGQSCTLPKRSDSELKDEKPKRPEDESGRDYREREREYERDQERILRERERLKRQEEERRRQKERYEKEKTFKRKEEEMKKEKDTLRDKGKKAESTESIGSSEKTEKKEEVVKRDRIRNKDRPAMQLYQPGARSRNRLCPPDDSTKSGDSAAERKQESGISHRKEGGEE

SEQ ID NO: 69321 - protein, 470 aa, Homo sapiens
MKEEKEHRPKEKRVTLLTPAGATGSGGGTSGDSSKGEDKQDRNKEKKEALSKVVIRRLPPTLTKEQLQEHLQPMPEHDYFEFFSNDTSLYPHMYARAYINFKNQEDIILFRDRFDGYVFLDNKGQEYPAIVEFAPFQKAAKKKTKKRDTKVGTIDDDPEYRKFLESYATDNEKMTSTPETLLEEIEAKNRELIAKKTTPLLSFLKNKQRMREEKREERRRREIERKRQREEERRKWKEEEKRKRKDIEKLKKIDRIPERDKLKDEPKIKLLKKPEKGDEKELDKREKAKKLDKENLSDERASGQSCTLPKRSDSELKDEKPKRPEDESGRDYREREREYERDQERILRERERLKRQEEERRRQKERYEKEKTFKRKEEEMKKEKDTLRDKGKKAESTESIGSSEKTEKKEEVVKRDRIRNKDRPAMQLYQPGARSRNRLCPPDDSTKSGDSAAERKQESGISHRKEGGEE

SEQ ID NO: 69322 - protein, 218 aa, Homo sapiens [sequence omitted]

SEQ ID NO: 69323 - protein, 888 aa, Homo sapiens
MEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKMALCQFALPLVLPDSENHYHTFLLWAMRGIVRTWWSQPPRGMGSFREDSVVLSRAPAFAFVRMDVSSNSKSQLLNAVLSPGHRQWDCFWHRDLNLGTNAREISDGLVEISWFFPSGREDLDIFPEPVAFLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYRRDELRLQGDPWRKAAQVEKEFCQLQWAVDPPEKHRAELRRRLLELRMQQNGHDPSSGVQEFISGISSPSLSEKQYFLRWMEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPEKQHIWHIPGLWHGAPPMAAVSLAYSEAIFELKRCLLENIRNGLSNQNKNIQQLIELVRRL

SEQ ID NO: 69324 - protein, 888 aa, Homo sapiens; identical to SEQ ID NO: 69323

SEQ ID NO: 69325 - protein, 922 aa, Homo sapiens
MASPGHSDLGEVAPEIKASERRTAVAIADLEWREMEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKMALCQFALPLVLPDSENHYHTFLLWAMRGIVRTWWSQPPRGMGSFREDSVVLSRAPAFAFVRMDVSSNSKSQLLNAVLSPGHRQWDCFWHRDLNLGTNAREISDGLVEISWFFPSGREDLDIFPEPVAFLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYRRDELRLQGDPWRKAAQVEKEFCQLQWAVDPPEKHRAELRRRLLELRMQQNGHDPSSGVQEFISGISSPSLSEKQYFLRWMEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPEKQHIWHIPGLWHGAPPMAAVSLAYSEAIFELKRCLLENIRNGLSNQNKNIQQLIELVRRL

SEQ ID NO: 69326 - protein, 163 aa, Homo sapiens
MEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKM

SEQ ID NO: 69327 - protein, 888 aa, Homo sapiens; identical to SEQ ID NO: 69323

SEQ ID NO: 69328 - protein, 888 aa, Homo sapiens; identical to SEQ ID NO: 69323

SEQ ID NO: 69329 - protein, 931 aa, Homo sapiens
MASPGIEVELLGKGHSDLGEVAPEIKASERRTAVAIADLEWREMEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKMALCQFALPLVLPDSENHYHTFLLWAMRGIVRTWWSQPPRGMGSFREDSVVLSRAPAFAFVRMDVSSNSKSQLLNAVLSPGHRQWDCFWHRDLNLGTNAREISDGLVEISWFFPSGREDLDIFPEPVAFLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYRRDELRLQGDPWRKAAQVEKEFCQLQWAVDPPEKHRAELRRRLLELRMQQNGHDPSSGVQEFISGISSPSLSEKQYFLRWMEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPEKQHIWHIPGLWHGAPPMAAVSLAYSEAIFELKRCLLENIRNGLSNQNKNIQQLIELVRRL

SEQ ID NO: 69330 - protein, 122 aa, Homo sapiens
MEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLA

SEQ ID NO: 69331 - protein, 540 aa, Homo sapiens
MAWVLKMDEVIESGLVHDFDASLSGIGQELGAGAYSMSDVLALPIFKQEDSSLPLDGETEHPPFQYVMCAATSPAVKLHDETLTYLNQGQSYEIRMLDNRKMGDMPEINGKLVKSIIRVVFHDRRLQYTEHQQLEGWKWNRPGDRLLDLDIPMSVGIIDTRTNPSQLNAVEFLWDPAKRTSAFIQVHCISTEFTPRKHGGEKGVPFRIQVDTFKQNENGEYTDHLHSASCQIKVFKPKGADRKQKTDREKMEKRTAHEKEKYQPSYDTTILTEMRLEPIIEDAVEHEQKKSSKRTLPADYGDSLAKRGSCSPWPDAPTAYVNNSPSPAPTFTSPQQSTCSVPDSNSSSPNHQGDGASQTSGEQIQPSATIQETQQWLLKNRFSSYTRLFSNFSGADLLKLTKEDLVQICGAADGIRLYNSLKSRSVRPRLTIYVCREQPSSTVLQGQQQAASSASENGSGAPYVYHAIYLEEMIASEVARKLALVFNIPLHQINQVYRQGPTGIHILVSDQMVQNFQDESCFLFSTVKAESSDGIHIILK

SEQ ID NO: 69332 - protein, 540 aa, Homo sapiens; identical to SEQ ID NO: 69331

SEQ ID NO: 69333 - protein, 504 aa, Homo sapiens
MAWVLKMDEVIESGLVHDFDASLSGIGQELGAGAYSMSDVLALPIFKQEDSSLPLDGETEHPPFQYVMCAATSPAVKLHDETLTYLNQGQSYEIRMLDNRKMGDMPEINGKLVKSIIRVVFHDRRLQYTEHQQLEGWKWNRPGDRLLDLDIPMSVGIIDTRTNPSQLNAVEFLWDPAKRTSAFIQVHCISTEFTPRKHGGEKGVPFRIQVDTFKQNENGEYTDHLHSASCQIKVFKPKGADRKQKTDREKMEKRTAHEKEKYQPSYDTTILTECSPWPDAPTAYVNNSPSPAPTFTSPQQSTCSVPDSNSSSPNHQGDGASQTSGEQIQPSATIQETQQWLLKNRFSSYTRLFSNFSGADLLKLTKEDLVQICGAADGIRLYNSLKSRSVRPRLTIYVCREQPSSTVLQGQQQAASSASENGSGAPYVYHAIYLEEMIASEVARKLALVFNIPLHQINQVYRQGPTGIHILVSDQMVQNFQDESCFLFSTVKAESSDGIHIILK

SEQ ID NO: 69334 - protein, 148 aa, Homo sapiens
MAWVLKMDEVIESGLVHDFDASLSGIGQELGAGAYSMSDVLALPIFKQEDSSLPLDGETEHPPFQYVMCAATSPAVKLHDETLTYLNQGQSYEIRMLDNRKMGDMPEINGKLVKSIIRVVFHDRRLQYTEHQQLEGWKWNRPGDRLLD

SEQ ID NO: 69335 - protein, 764 aa, Homo sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDATTKEVKDSLGKQWSQLSDKKRLKWIHKALEQRKEYEEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQATSPASKKPAQEGGKGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQKQYKVHLDLWVKSLSPQDRAAYKEYISNKRKSMTKLRGPNPKSSRTTLQSKSESEEDDEEDEDDEDEDEEEEDDENGDSSEDGGDSSESSSEDESEDGDENEEDDEDEDDDEDDDEDEDNESEGSSSSSSSSGDSSDSDSN

SEQ ID NO: 69336 - protein, 727 aa, Homo sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQATSPASKKPAQEGGKGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQKQYKVHLDLWVKSLSPQDRAAYKEYISNKRKSMTKLRGPNPKSSRTTLQSKSESEEDDEEDEDDEDEDEEEEDDENGDSSEDGGDSSESSSEDESEDGDENEEDDEDEDDDEDDDEDEDNESEGSSSSSSSSGDSSDSDSN

SEQ ID NO: 69337 - protein, 727 aa, Homo sapiens; identical to SEQ ID NO: 69336

SEQ ID NO: 69338 - protein, 764 aa, Homo sapiens; identical to SEQ ID NO: 69335

SEQ ID NO: 69339 - protein, 727 aa, Homo sapiens; identical to SEQ ID NO: 69336

SEQ ID NO: 69340 - protein, 764 aa, Homo sapiens; identical to SEQ ID NO: 69335

SEQ ID NO: 69341 - protein, 727 aa, Homo sapiens; identical to SEQ ID NO: 69336

SEQ ID NO: 69342 - protein, 282 aa, Homo sapiens
MKGQQKTAETEEGTVQIQEGAVATGEDPTSVAIASIQSAATFPDPNVKYVFRTENGGQVMYRVIQVSEGQLDGQTEGTGAISGYPATQSMTQAVIQGAFTSDDAVDTEGTAAETHYTYFPSTAVGDGAGGQFFVMMSPQEVLQGGSQRSIAPRTHPYSPKSEAPRTTRDEKRRAQHNEVERRRRDKINNWIVQLSKIIPDCSMESTKSGQSKGGILSKACDYIQELRQSNHRLSEELQGLDQLQLDNDVLRQQVEDLKNKNLLLRAQLRHHGLEVVIKNDSN

SEQ ID NO: 69343 - protein, 310 aa, Homo sapiens
MKGQQKTAETEEGTVQIQEGAVATGEDPTSVAIASIQSAATFPDPNVKYVFRTENGGQVMYRVIQVSEGQLDGQTEGTGAISGYPATQSMTQAVIQGAFTSDDAVDTEGTAAETHYTYFPSTAVGDGAGGTTSGSTAAVVTTQGSEALLGQATPPGTGQFFVMMSPQEVLQGGSQRSIAPRTHPYSPKSEAPRTTRDEKRRAQHNEVERRRRDKINNWIVQLSKIIPDCSMESTKSGQSKGGILSKACDYIQELRQSNHRLSEELQGLDQLQLDNDVLRQQVEDLKNKNLLLRAQLRHHGLEVVIKNDSN

SEQ ID NO: 69344 - protein, 310 aa, Homo sapiens; identical to SEQ ID NO: 69343

SEQ ID NO: 69345 - protein, 251 aa, Homo sapiens
MYRVIQVSEGQLDGQTEGTGAISGYPATQSMTQAVIQGAFTSDDAVDTEGTAAETHYTYFPSTAVGDGAGGTTSGSTAAVVTTQGSEALLGQATPPGTGQFFVMMSPQEVLQGGSQRSIAPRTHPYSPKSEAPRTTRDEKRRAQHNEVERRRRDKINNWIVQLSKIIPDCSMESTKSGQSKGGILSKACDYIQELRQSNHRLSEELQGLDQLQLDNDVLRQQVEDLKNKNLLLRAQLRHHGLEVVIKNDSN

SEQ ID NO: 69346 - protein, 384 aa, Homo sapiens
MAGAEWKSLEECLEKHLPLPDLQEVKRVLYGKELRKLDLPREAFEAASREDFELQGYAFEAAEEQLRRPRIVHVGLVQNRIPLPANAPVAEQVSALHRRIKAIVEVAAMCGVNIICFQEAWTMPFAFCTREKLPWTEFAESAEDGPTTRFCQKLAKNHDMVVVSPILERDSEHGDVLWNTAVVISNSGAVLGKTRKNHIPRVGDFNESTYYMEGNLGHPVFQTQFGRIAVNICYGRHHPLNWLMYSINGAEIIFNPSATIGALSESLWPIEARNAAIANHCFTCAINRVGTEHFPNEFTSGDGKKAHQDFGYFYGSSYVAAPDSSRTPGLSRSRDGLLVAKLDLNLCQQVNDVWNFKMTGRYEMYARELAEAVKSNYSPTIVKE

SEQ ID NO: 69347 - protein, 316 aa, Homo sapiens
MLGEAPAAPRLAGSEARSLWQGTQVSALHRRIKAIVEVAAMCGVNIICFQEAWTMPFAFCTREKLPWTEFAESAEDGPTTRFCQKLAKNHDMVVVSPILERDSEHGDVLWNTAVVISNSGAVLGKTRKNHIPRVGDFNESTYYMEGNLGHPVFQTQFGRIAVNICYGRHHPLNWLMYSINGAEIIFNPSATIGALSESLWPIEARNAAIANHCFTCAINRVGTEHFPNEFTSGDGKKAHQDFGYFYGSSYVAAPDSSRTPGLSRSRDGLLVAKLDLNLCQQVNDVWNFKMTGRYEMYARELAEAVKSNYSPTIVKE

SEQ ID NO: 69348 - protein, 186 aa, Homo sapiens
MAGAEWKSLEECLEKHLPLPDLQEVKRVLYGKELRKLDLPREAFEAASREDFELQGYAFEAAEEQLRRPRIVHVGLVQNRIPLPANAPVAEQVSALHRRIKAIVEVAAMCGVNIICFQEAWILRPHHQEPRPPCCYAPSCCLIPSVFPHRSESIRSSPSLYHHLVQAPGSSPLAFVIPSSWSPVPS

SEQ ID NO: 69349 - protein, 480 aa, Homo sapiens
MAVARAALGPLVTGLYDVQAFKFGDFVLKSGLSSPIYIDLRGIVSRPRLLSQVADILFQTAQNAGISFDTVCGVPYTALPLATVICSTNQIPMLIRRKETKDYGTKRLVEGTINPGETCLIIEDVVTSGSSVLETVEVLQKEGLKVTDAIVLLDREQGGKDKLQAHGIRLHSVCTLSKMLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEGGIFKIASWADLVNAHVVPGSGVVKGLQEVGLPLHRGCLLIAEMSSTGSLATGDYTRAAVRMAEEHSEFVVGFISGSRVSMKPEFLHLTPGVQLEAGGDNLGQQYNSPQEVIGKRGSDIIIVGRGIISAADRLEAAEMYRKAAWEAYLSRLGV

SEQ ID NO: 69350 - protein, 205 aa, Homo sapiens
MLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEGDNLGQQYNSPQEVIGKRGSDIIIVGRGIISAADRLEAAEMYRKAAWEAYLSRLGV

SEQ ID NO: 69351 - protein, 388 aa, Homo sapiens
MLIRRKETKDYGTKRLVEGTINPGETCLIIEDVVTSGSSVLETVEVLQKEGLKVTDAIVLLDREQGGKDKLQAHGIRLHSVCTLSKMLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEGGIFKIASWADLVNAHVVPGSGVVKGLQEVGLPLHRGCLLIAEMSSTGSLATGDYTRAAVRMAEEHSEFVVGFISGSRVSMKPEFLHLTPGVQLEAGGDNLGQQYNSPQEVIGKRGSDIIIVGRGIISAADRLEAAEMYRKAAWEAYLSRLGV

SEQ ID NO: 69352 - protein, 302 aa, Homo sapiens
MLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEGGIFKIASWADLVNAHVVPGSGVVKGLQEVGLPLHRGCLLIAEMSSTGSLATGDYTRAAVRMAEEHSEFVVGFISGSRVSMKPEFLHLTPGVQLEAGGDNLGQQYNSPQEVIGKRGSDIIIVGRGIISAADRLEAAEMYRKAAWEAYLSRLGV

SEQ ID NO: 69353 - protein, 310 aa, Homo sapiens
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIGLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 69354 - protein, 310 aa, Homo sapiens; identical to SEQ ID NO: 69353

SEQ ID NO: 69355 - protein, 310 aa, Homo sapiens; identical to SEQ ID NO: 69353

SEQ ID NO: 69356 - protein, 144 aa, Homo sapiens
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGG

SEQ ID NO: 69357 - protein, 171 aa, Homo sapiens
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIGILKHLRRKDTGKSKGGRERRSTKLR

SEQ ID NO: 69358 - protein, 173 aa, Homo sapiens
MQRKLKVTSLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 69359 - protein, 29 aa, Homo sapiens
MAATGANAEKAESHNDCPVRLLNPNIAKM

SEQ ID NO: 69360 - protein, 146 aa, Homo sapiens
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIG

SEQ ID NO: 69361 - protein, 201 aa, Homo sapiens
MASAGGEDCESPAPEADRPHQRPFLIGVSGGTASGKSTVCEKIMELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRDKEVCRCDHPARSGQYGCHQPDRAAHPGHSEW

SEQ ID NO: 69362 - protein, 268 aa, Homo sapiens
MASAGGEDCESPAPEADRPHQRPFLIGSTVCEKIMELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRVLRDVRRGRDLEQILTQYTTFVKPAFEEFCLPTKKYADVIIPRGVDNMVAINLIVQHIQDILNGDICKWHRGGSNGRSYKRTFSEPGDHPGMLTSGKRSHLESSSRPH

SEQ ID NO: 69363 - protein, 282 aa, Homo sapiens
MASAGGEDCESPAPEADRPHQRPFLIGDERFQAGIPLLCLQSTVCEKIMELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRVLRDVRRGRDLEQILTQYTTFVKPAFEEFCLPTKKYADVIIPRGVDNMVAINLIVQHIQDILNGDICKWHRGGSNGRSYKRTFSEPGDHPGMLTSGKRSHLESSSRPH

SEQ ID NO: 69364 - protein, 277 aa, Homo sapiens
MASAGGEDCESPAPEADRPHQRPFLIGVSGGTASGKSTVCEKIMELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRVLRDVRRGRDLEQILTQYTTFVKPAFEEFCLPTKKYADVIIPRGVDNMVAINLIVQHIQDILNGDICKWHRGGSNGRSYKRTFSEPGDHPGMLTSGKRSHLESSSRPH

SEQ ID NO: 69365 - protein, 548 aa, Homo sapiens
MAAPPARADADPSPTSPPTARDTPGRQAEKSETACEDRSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 69366 - protein, 419 aa, Homo sapiens
MAAPPARADADPSPTSPPTARDTPGRQAEKSETACEDRSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEEGCAGLGTPVPPAAPDAERPEEHAAGTGHAHHHQVRAHLGTGRPRARAPAQLLAPQGQGDQSRRVHLLLQETDAAAHRARALLPALSGLRRTDPAGAGLCGQVLCGEADHRCVHSARR

SEQ ID NO: 69367 - protein, 548 aa, Homo sapiens
MAAPPARADADPSPTSPPTARDTPGRQAEKSETACEDRSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEELRFVPRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 69368 - protein, 533 aa, Homo sapiens
MSSPPAYPGIRISGCRALGAEGSSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 69369 - protein, 86 aa, Homo sapiens
MSSPPAYPGIRISGCRALGAEGSSNAESLDRLLPPVGTGRSPRKRTTSQCKSEPPLLRTSKRTIYTAGRPPWYNEHGTQSKEAFAI

SEQ ID NO: 69370 - protein, 135 aa, Homo sapiens
MHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLL

SEQ ID NO: 69371 - protein, 261 aa, Homo sapiens
MAGDSEQTLQNHQQPNGGEPFLIGVSGGTASGKSSVCAKIVQLLGQNEVDYRQKQVVILSQDSFYRVLTSEQKAKALKGQFNFDHPDAFDNELILKTLKEITEGKTVQIPVYDFVSHSRKEETVTVYPADVVLFEGILAFYSQEVRDLFQMKLFVDTDADTRLSRRVLRDISERGRDLEQILSQYITFVKPAFEEFCLPTKKYADVIIPRGADNLVAINLIVQHIQDILNGGPSKRQTNGCLNGYTPSRKRQASESSSRPH

SEQ ID NO: 69372 - protein, 130 aa, Homo sapiens
MAGDSEQTLQNHQQPNGGEPFLIGVSGGTASGKSSVCAKIVQLLGQNEVDYRQKQVVILSQDSFYRVLTSEQKAKALKGQFNFDHPDAFDNELILKTLKEITEGKTVQIPVYDFVSHSRIKGHQRERQGS

SEQ ID NO: 69373 - protein, 676 aa, Homo sapiens
MSSLQALCSGLPLRPLPENRGRQAGVPHAPVRTPSLSPVEKQLALRNALRYFPPDVQELLAPEFAQELQLYGHIYMYRFCPDIEMRAYPIEQYPCQTKVAAAIMHMIMNNLDPAVAQFPQELVTYGGNGQVFSNWAQFWLTMFYLSKMTEEQTLVMYSGHPLGLFPSSRSAPRLVITNGMVIPNYSSRTEYEKLFALGVTMYGQMTAGSYCYIGPQGIVHGTVLTVLNAARRYLGIEDLAGKVFVTSGLGGMSGAQAKAAVIVGCIGVIAEVDKAALEKRHRQGWLMEVTDSLDRCIQRLREARKKKEVLSLGYHGNVVALWERLVHELDTTGECLVDLGSDQTSCHNPFNGGYYPVQLSFTEAQSLMASNPAVFKDLVQESLRRQVSAINRLAEEKFFFWDYGNAFLLEAQRAGADVEKKGAGRTEFRYPSYVQHIMGDIFSQGFGPFRWVCTSGDPQDLAVTDELATSVLEEAIADGVKVSVKLQYMDNIRWIREAARHRLVVGSQARILYSDQKGRVAIAVAINQAIACRRIKAPVVLSRDHHDVSGTDSPFRETSNIYDGSAFCADMAVQNFVGDACRGATWVALHNGGGVGWGEVINGGFGLVLDGTPEAEGRARLMLSWDVSNGVARRCWSGNQKAYEIICQTMQENSTLVVTLPHKVEDERVLQQALQL

SEQ ID NO: 69374 - protein, 736 aa, Homo sapiens
MSSLQALCSGLPLRPLPENRGRQAGVPHAPVRTPSLSPVEKQLALRNALRYFPPDVQELLAPEFAQELQLYGHIYMYRFCPDIEMRAYPIEQYPCQTKVAAAIMHMIMNNLDPAVAQFPQELVTYGGNGQVFSNWAQFWLTMFYLSKMTEEQTLVMYSGHPLGLFPSSRSAPRLVITNGMVIPNYSSRTEYEKLFALGVTMYGQMTAGSYCYIGPQGIVHGTVLTVLNAARRYLGIEDLAGKVFVTSGLGGMSGAQAKAAVIVGCIGVIAEVDKAALEKRHRQGWLMEVTDSLDRCIQRLRVLQLGLQQALGWAGLPAALGLCVLSCFVNLAPLGEGRCLAPSGFSRPLLGAPVLLLCPSREARKKKEVLSLGYHGNVVALWERLVHELDTTGECLVDLGSDQTSCHNPFNGGYYPVQLSFTEAQSLMASNPAVFKDLVQESLRRQVSAINRLAEEKFFFWDYGNAFLLEAQRAGADVEKKGAGRTEFRYPSYVQHIMGDIFSQGFGPFRWVCTSGDPQDLAVTDELATSVLEEAIADGVKVSVKLQYMDNIRWIREAARHRLVVGSQARILYSDQKGRVAIAVAINQAIACRRIKAPVVLSRDHHDVSGTDSPFRETSNIYDGSAFCADMAVQNFVGDACRGATWVALHNGGGVGWGEVINGGFGLVLDGTPEAEGRARLMLSWDVSNGVARRCWSGNQKAYEIICQTMQENSTLVVTLPHKVEDERVLQQALQL

SEQ ID NO: 69375 - protein, 124 aa, Homo sapiens
MRQAGRAALLAALLLLVQLCPGSSQRSPEAAGVQDPSLRWSPGARNQGGGARALLLLLAERFPRRAGPGRLGLGTAGERPRRDNPSLSIDLTFHLLRTLLELARTQSQRERAEQNRIIFDSVGK

SEQ ID NO: 69376 - protein, 112 aa, Homo sapiens
MTRCALLLLMVLMLGRVLVVPVTPIPTFQLRPQNSPQTTPRPAASESPSAAPTWPWAAQSHCSPTRHPGSRIVLSLDVPIGLLQILLEQARARAAREQATTNARILARVGHC

SEQ ID NO: 69377 - protein, 640 aa, Homo sapiens
MGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCPAGYRGDGWHCECSPGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHCQCKQDFNITDISLLEHRLECGANDMKVSLGKCQLKSLGFDKVFMYLSDSRCSGFNDRDNRDWVSVVTPARDGPCGTVLTRNETHATYSNTLYLADEIIIRDLNIKINFACSYPLDMKVSLKTALQPMVSALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLHCEVYLCDTMNEKCKPTCSGTRFRSGSVIDQSRVLNLGPITRKGVQATVSRAFSSLGLLKVWLPLLLSATLTLTFQ

SEQ ID NO: 69378 - protein, 673 aa, Homo sapiens
MGQPSLTWMLMVVVASWFITTAATDTSEARTKYNCPARWSWRTPQRGGDTEQGPDEDFTSQGRWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCPAGYRGDGWHCECSPGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHCQCKQDFNITDISLLEHRLECGANDMKVSLGKCQLKSLGFDKVFMYLSDSRCSGFNDRDNRDWVSVVTPARDGPCGTVLTRNETHATYSNTLYLADEIIIRDLNIKINFACSYPLDMKVSLKTALQPMVSALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLHCEVYLCDTMNEKCKPTCSGTRFRSGSVIDQSRVLNLGPITRKGVQATVSRAFSSLGLLKVWLPLLLSATLTLTFQ

SEQ ID NO: 69379 - protein, 640 aa, Homo sapiens; identical to SEQ ID NO: 69377

SEQ ID NO: 69380 - protein, 640 aa, Homo sapiens; identical to SEQ ID NO: 69377

SEQ ID NO: 69381 - protein, 673 aa, Homo sapiens; identical to SEQ ID NO: 69378

SEQ ID NO: 69382 - protein, 618 aa, Homo sapiens
MGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHCQCKQDFNITDISLLEHRLECGANDMKVSLGKCQLKSLGFDKVFMYLSDSRCSGFNDRDNRDWVSVVTPARDGPCGTVLTRNETHATYSNTLYLADEIIIRDLNIKINFACSYPLDMKVSLKTALQPMVSALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLHCEVYLCDTMNEKCKPTCSGTRFRSGSVIDQSRVLNLGPITRKGVQATVSRAFSSLGLLKVWLPLLLSATLTLTFQ

SEQ ID NO: 69383 - protein, 252 aa, Homo sapiens
MAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTKYVLEKLDFQS

SEQ ID NO: 69384 - protein, 184 aa, Homo sapiens
MAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEARGLEIHLELRATSTSHGTPLSSAENCL

SEQ ID NO: 69385 - protein, 1246 aa, Homo sapiens
MVYRTQYLVVEVPESRNVTDCCEGYEQLGLYCVLPLNQSGQFTSRPGACPAEGPEPSTSPCSLDIDCPGLEKCCPWSGGRYCMAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTNAQVFEVTIKIVNHNLTEKLLNRSSVEYQDFSRQLLHEVESSFPPVVSDLYRSGKLRMQIVSLQAGSVVVRLKLTVQDPGFPMGISTLAPILQPLLASTVFQIDRQGTRVQDWDECVDSAEHDCSPAAWCINLEGSYTCQCRTTRDATPSRAGRACEGDLVSPMGGGLSAATGVTVPGLGTGTAALGLENFTLSPSPGYPQGTPAAGQAWTPEPSPRRGGSNVVGYDRNNTGKGVEQELQGNSIMEPPSWPSPTEDPTGHFLWHATRSTRETLLNPTWLRNEDSGPSGSVDLPLTSTLTALKTPACVPVSIGRIMVSNVTSTGFHLAWEADLAMDSTFQLTLTSMWSPAVVLETWNTSVTLSGLEPGVLHLVEIMAKACGKEGARAHLKVRTAARKLIGKVRIKNVRYSESFRNASSQEYRDFLELFFRMVRGSLPATMCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGYVVLIVVAIFVLVAGTATLLIVRYQRMNGRYNFKIQSNNFSYQVFYE

SEQ ID NO: 69386 - protein, 1374 aa, Homo sapiens
MVYRTQYLVVEVPESRNVTDCCEGYEQLGLYCVLPLNQSGQFTSRPGACPAEGPEPSTSPCSLDIDCPGLEKCCPWSGGRYCMAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTNAQVFEVTIKIVNHNLTEKLLNRSSVEYQDFSRQLLHEVESSFPPVVSDLYRSGKLRMQIVSLQAGSVVVRLKLTVQDPGFPMGISTLAPILQPLLASTVFQIDRQGTRVQDWDECVDSAEHDCSPAAWCINLEGSYTCQCRTTRDATPSRAGRACEGDLVSPMGGGLSAATGVTVPGLGTGTAALGLENFTLSPSPGYPQGTPAAGQAWTPEPSPRRGGSNVVGYDRNNTGKGVEQEVPSTAPGLGMDQGSPSQVNPSQGSPSQGSLRQESTSQASPSQRSTSQGSPSQVNPSQRSTSHANSSQGSPSQGSPSQESPSQGSTSQASPSHRNTIGVIGTTSSPKATGSTHSFPPGATDGPLALPGQLQGNSIMEPPSWPSPTEDPTGHFLWHATRSTRETLLNPTWLRNEDSGPSGSVDLPLTSTLTALKTPACVPVSIGRIMVSNVTSTGFHLAWEADLAMDSTFQLTLTSMWSPAVVLETWNTSVTLSGLEPGVLHLVEIMAKACGKEGARAHLKVRTAARKLIGKVRIKNVRYSESFRNASSQEYRDFLELFFRMVRGSLPATMCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGYVVLIVVAIFVLVAGTATLLIVRYQRMNGRYNFKIQSNNFSYQVFYE

SEQ ID NO: 69387 - protein, 1318 aa, Homo sapiens
MLRTSGLALLALVSAVGPSQASGFTEKGLSLLGYQLCSHRVTHTVQKVEAVQTSYTSYVSCGGWIPWRRCPKMVYRTQYLVVEVPESRNVTDCCEGYEQLGLYCVLPLNQSGQFTSRPGACPAEGPEPSTSPCSLDIDCPGLEKCCPWSGGRYCMAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTNAQVFEVTIKIVNHNLTEKLLNRSSVEYQDFSRQLLHEVESSFPPVVSDLYRSGKLRMQIVSLQAGSVVVRLKLTVQDPGFPMGISTLAPILQPLLASTVFQIDRQGTRVQDWDECVDSAEHDCSPAAWCINLEGSYTCQCRTTRDATPSRAGRACEGDLVSPMGGGLSAATGVTVPGLGTGTAALGLENFTLSPSPGYPQGTPAAGQAWTPEPSPRRGGSNVVGYDRNNTGKGVEQELQGNSIMEPPSWPSPTEDPTGHFLWHATRSTRETLLNPTWLRNEDSGPSGSVDLPLTSTLTALKTPACVPVSIGRIMVSNVTSTGFHLAWEADLAMDSTFQLTLTSMWSPAVVLETWNTSVTLSGLEPGVLHLVEIMAKACGKEGARAHLKVRTAARKLIGKVRIKNVRYSESFRNASSQEYRDFLELFFRMVRGSLPATMCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGYVVLIVVAIFVLVAGTATLLIVRYQRMNGRYNFKIQSNNFSYQVFYE

SEQ ID NO: 69388 - protein, 1446 aa, Homo sapiens
MLRTSGLALLALVSAVGPSQASGFTEKGLSLLGYQLCSHRVTHTVQKVEAVQTSYTSYVSCGGWIPWRRCPKMVYRTQYLVVEVPESRNVTDCCEGYEQLGLYCVLPLNQSGQFTSRPGACPAEGPEPSTSPCSLDIDCPGLEKCCPWSGGRYCMAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTNAQVFEVTIKIVNHNLTEKLLNRSSVEYQDFSRQLLHEVESSFPPVVSDLYRSGKLRMQIVSLQAGSVVVRLKLTVQDPGFPMGISTLAPILQPLLASTVFQIDRQGTRVQDWDECVDSAEHDCSPAAWCINLEGSYTCQCRTTRDATPSRAGRACEGDLVSPMGGGLSAATGVTVPGLGTGTAALGLENFTLSPSPGYPQGTPAAGQAWTPEPSPRRGGSNVVGYDRNNTGKGVEQEVPSTAPGLGMDQGSPSQVNPSQGSPSQGSLRQESTSQASPSQRSTSQGSPSQVNPSQRSTSHANSSQGSPSQGSPSQESPSQGSTSQASPSHRNTIGVIGTTSSPKATGSTHSFPPGATDGPLALPGQLQGNSIMEPPSWPSPTEDPTGHFLWHATRSTRETLLNPTWLRNEDSGPSGSVDLPLTSTLTALKTPACVPVSIGRIMVSNVTSTGFHLAWEADLAMDSTFQLTLTSMWSPAVVLETWNTSVTLSGLEPGVLHLVEIMAKACGKEGARAHLKVRTAARKLIGKVRIKNVRYSESFRNASSQEYRDFLELFFRMVRGSLPATMCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGYVVLIVVAIFVLVAGTATLLIVRYQRMNGRYNFKIQSNNFSYQVFYE

SEQ ID NO: 69389 - protein, 77 aa, Homo sapiens
PVGSWYNVTILVKMDFKELQQVDPRLLNHMRLLHSLMSMSVSMRSSMPALEGNCAQTWRARTGASVTRKLQPRLHGS

SEQ ID NO: 69390 - protein, 136 aa, Homo sapiens
MQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKIAALGRRTHVDWWAFPISQWLS

SEQ ID NO: 69391 - protein, 406 aa, Homo sapiens
MKKKQQHPGGGADPWPHGAPMGGAPPGLGSWKRRVPLLPFLRFSLRDYGFCMATLLVFCLGSLLYQLSGGPPRFLLDLRQYLGNSTYLDDHGPPPSKVLPFPSQVVYNRVGKCGSRTVVLLLRILSEKHGFNLVTSDIHNKTRLTKNEQMELIKNISTAEQPYLFTRHVHFLNFSRFGGDQPVYINIIRDPVNRFLSNYFFRRFGDWRGEQNHMIRTPSMRQEERYLDINECILENYPECSNPRLFYIIPYFCGQHPRCREPGEWALERAKLNVNENFLLVGILEELEDVLLLLERFLPHYFKGVLSIYKDPEHRKLGNMTVTVKKTVPSPEAVQILYQRMRYEYEFYHYVKEQFHLLKRKFGLKSHVSKPPLRPHFFIPTPLETEEPIDDEEQDDEKWLEDIYKR

SEQ ID NO: 69392 - protein, 258 aa, Homo sapiens
MASAAAAEAEKGSPVVVGLLVVGNIIILLSGLSLFAETIWVTADQYRVYPLMGVSGKDDVFAGAWIAIFCGFSFFMVASFGVGAALCRRRSMVLTYLVLMLIVYIFECASCITSYTHRDYMVSNPSLITKQMLTFYSADTDQGQELTRLWDRVMIEQECCGTSGPMDWVNFTSAFRAATPEVVFPWPPLCCRRTGNFIPLNEEGCRLGHMDYLFTKGCFEHIGHAIDSYTWGISWFGFAILMWTLPVMLIAMYFYTML

SEQ ID NO: 69393 - protein, 273 aa, Homo sapiens
MASAAAAEAEKGSPVVVGLLVVGNIIILLSGLSLFAETIWVTADQYRVYPLMGVSGKDDVFAGAWIAIFCGFSFFMVASFGVGAALCRRRSMVLTYLVLMLIVYIFECASCITSYTHRDYMVSNPSLITKQMLTFYSADTDQGQELTRLWDRVMIEQECCGTSGPMDWVNFTSAFRAATPEVVFPWPPLCCRRTGNFIPLNEEGCRLGHMDYLFTKAGVQWHNLSSLQRLPPGFKGFSHLSFQSSWDYRAASNTSATPSTATRGVSRGLGLPS

SEQ ID NO: 69394 - protein, 260 aa, Homo sapiens
MAKDNSTVRCFQGLLIFGNVIIGCCGIALTAECIFFVSDQHSLYPLLEATDNDDIYGAAWIGIFVGICLFCLSVLGIVGIMKSSRKILLAYFILMFIVYAFEVASCITAATQQDFFTPNLFLKQMLERYQNNSPPNNDDQWKNNGVTKTWDRLMLQDNCCGVNGPSDWQKYTSAFRTENNDADYPWPRQCCVMNNLKEPLNLEACKLGVPGFYHNQGCYELISGPMNRHAWGVAWFGFAILCWTFWVLLGTMFYWSRIEY

SEQ ID NO: 69395 - protein, 169 aa, Homo sapiens
MAKDNSTVRCFQGLLIFGNVIIGCCGIALTAECIFFVSDQHSLYPLLEATDNDDIYGAAWIGIFVGICLFCLSVLGIVGIMKSSRKILLAYFILMFIVYAFEVASCITAATQQDFFTPNLFLKQMLERYQNNSPPNNDDQWKNNGVTKTWDRLMLQDNCCGVNGPSDWQ

SEQ ID NO: 69396 - protein, 189 aa, Homo sapiens
MAKDNSTVRCFQGLLIFGNVIIGCCGIALTAECIFFVSDQHSLYPLLEATDNDDIYGAAWIGIFVGICLFCLSVLGIVGIMKSSRKILLAYFILMFIVYAFEVASCITAATQQDFFTPNLFLKQMLERYQNNSPPNNDDQWKNNGVTKTWDRLMLQDNCCGVNGPSDWQKYTSAFRTENNDADYPWPRQ

SEQ ID NO: 69397 - protein, 184 aa, Homo sapiens
MAPLLPIRTLPLILILLALLSPGAADFNISSLSGLLSPALTESLLVALPPCHLTGGNATLMVRRANDSKVVTSSFVVPPCRGRRELVSVVDSGAGFTVTRLSAYQVTNLVPGTKFYISYLVKKGTATESSREIPMSTLPRRNMESIGLGMARTGGMVVITVLLSVAMFLLVLGFIIALALGSRK

SEQ ID NO: 69398 - protein, 287 aa, Homo sapiens
MPPLWALLALGCLRFGSAVNLQPQLASVTFATNNPTLTTVALEKPLCMFDSKEALTGTHEVYLYVLVDSAISRNASVQDSTNTPLGSTFLQTEGGRTGPYKAVAFDLIPCSDLPSLDAIGDVSKASQILNAYLVRVGANGTCLWDPNFQGLCNAPLSAATEYRFKYVLVNMSTGLVEDQTLWSDPIRTNQLTPYSTIDTWPGRRSGGMIVITSILGSLPFFLLVGFAGAIALSLVDMGSSDGETTHDSQITQEAVPKSLGASESSYTSVNRGPPLDRAEVYSSKLQD

SEQ ID NO: 69399 - protein, 166 aa, Homo sapiens
MPPLWALLALGCLRFGSAVNLQPQLASVTFATNNPTLTTVALEKPLCMFDSKEALTGTHEVYLYVLVDSVTPYSTIDTWPGRRSGGMIVITSILGSLPFFLLVGFAGAIALSLVDMGSSDGETTHDSQITQEAVPKSLGASESSYTSVNRGPPLDRAEVYSSKLQD

SEQ ID NO: 69400 - protein, 320 aa, Homo sapiens
MGLPWGQPHLGLQMLLLALNCLRPSLSLGEWGSWMDASSQTQGAGGPAGVIGPWAPAPLRLGEAAPGTPTPVSVAHLLSPVATELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPRIHRHLARAAKWQHDRHYLHPLFSGRPPTLGLLGSLYHALLQPVVAGGGPGAAADRLLHGQALHDPPHPTQRGRHTAGGLQAWPGPPPQPQPLAWPLCMGLGEMGRWE

SEQ ID NO: 69401 - protein, 276 aa, Homo sapiens
MGLPWGQPHLGLQMLLLALNCLRPSLSLELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYRVKFLLMDTRGSPRAETKWSDPITLHQGKTPGSIDTWPGRRSGSMIVITSILSSLAGLLLLAFLAASTMRFSSLWWPEEAPEQLRIGSFMGKRYMTHHIPPREAATLPVGCKPGLDPLPSLSP

SEQ ID NO: 69402 - protein, 320 aa, Homo sapiens; identical to SEQ ID NO: 69400

SEQ ID NO: 69403 - protein, 276 aa, Homo sapiens; identical to SEQ ID NO: 69401

SEQ ID NO: 69404 - protein, 320 aa, Homo sapiens; identical to SEQ ID NO: 69400

SEQ ID NO: 69405 - protein, 367 aa, Homo sapiens
MEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQALQLFESHAGHLGPQLFNKFALPYIRDVAKQVKARLREAGLAPVPMIIFAKDGHFALEELAQAGYEVVGLDWTVAPKKARECVGKTVTLQGNLDPCALYASEEEIGQLVKQMLDDFGPHRYIANLGHGLYPDMDPEHVGAFVDAVHKHSRLLRQN

SEQ ID NO: 69406 - protein, 193 aa, Homo sapiens
MEANGLGPQGFPELKNDTFLRAAWGEETDYTPVWCMRQAGRYLPEFRETRAAQDFFSTCRSPEACCELTLQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQAL

SEQ ID NO: 69407 - protein, 227 aa, Homo sapiens
PQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPALQLFESHAGHLGPQLFNKFALPYIRDVAKQVKARLREAGLAPVPMIIFAKDGHFALEELAQAGYEVVGLDWTVAP

SEQ ID NO: 69408 - protein, 228 aa, Homo sapiens
  MOD_RES (1)..(1): Any amino acid
XPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPALQLFESHAGHLGPQLFNKFALPYIRDVAKQVKARLREAGLAPVPMIIFAKDGHFALEELAQAGYEVVGLDWTVAP

SEQ ID NO: 69409 - protein, 193 aa, Homo sapiens; identical to SEQ ID NO: 69406

SEQ ID NO: 69410 - protein, 133 aa, Homo sapiens
MKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSSK

SEQ ID NO: 69411 - protein, 139 aa, Homo sapiens
MKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSSEEVKGIF

SEQ ID NO: 69412 - protein, 265 aa, Homo sapiens
MKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSRESSALPLLFPCGNLKREILPKALKDKGIAMESITVYQTVAHPGIQGNLNSYYSQQGVPASITFFSPSGLTYSLKHIQELSGDNIDQIKFAAIGPTTARALAAQGLPVSCTAESPTPQALATGIRKALQPHGCC

SEQ ID NO: 69413 - protein, 265 aa, Homo sapiens; identical to SEQ ID NO: 69412

SEQ ID NO: 69414 - protein, 185 aa, Homo sapiens
MKVLLLKDAKEDDCGQDPYIRLSHPEDYGGLIFTSPRAVEAAELCLEQNNKTEVWERSLKEKWNAKSVYVVGNATASLVSKIGLDTEGETCGNAEKLAEYICSRESSALPLLFPCGNLKREILPKALKDKGIAMESITVYQTVAHPGIQGNLNSYYSQQGVPASITFFSPSGLTYSLKHIQELSG

SEQ ID NO: 69415 - protein, 899 aa, Homo sapiens
MDRKVAREFRHKVDFLIENDAEKDYLYDVLRMYHQTMDVAVLVGDLKLVINEPSRLPLFDAIRPLIPLKHQVEYDQLTPRRSRKLKEVRLDRLHPEGLGLSVRGGLEFGCGLFISHLIKGGQADSVGLQVGDEIVRINGYSISSCTHEEVINLIRTKKTVSIKVRHIGLIPVKSSPDEPLTWQYVDQFVSESGGVRGSLGSPGNRENKEKKVFISLVGSRGLGCSISSGPIQKPGIFISHVKPGSLSAEVGLEIGDQIVEVNGVDFSNLDHKEAVNVLKSSRSLTISIVAAAGRELFMTDRERLAEARQRELQRQELLMQKRLAMESNKILQEQQEMERQRRKEIAQKAAEENERYRKEMEQIVEEEEKFKKQWEEDWGSKEQLLLPKTITAEVHPVPLRKPKSFGWFYRYDGKFPTIRKKGKDKKKAKYGSLQDLRKNKKELEFEQKLYKEKEEMLEKEKQLKINRLAQEVSETEREDLEESEKIQYWVERLCQTRLEQISSADNEISEMTTGPPPPPPSVSPLAPPLRRFAGGLHLHTTDLDDIPLDMFYYPPKTPSALPVMPHPPPSNPPHKVPAPPVLPLSGHVSASSSPWVQRTPPPIPIPPPPSVPTQDLTPTRPLPSALEEALSNHPFRTGDTGNPVEDWEAKNHSGKPTNSPVPEQSFPPTPKTFCPSPQPPRGPGVSTISKPVMVHQEPNFIYRPAVKSEVLPQEMLKRMVVYQTAFRQDFRKYEEGFDPYSMFTPEQIMGKDVRLLRIKKEGSLDLALEGGVDSPIGKVVVSAVYERGAAERHGGIVKGDEIMAINGKIVTDYTLAEAEAALQKAWNQGGDWIDLVVAVCPPKEYDDELASLPSSVAESPQPVRKLLEDRAAVHRHGFLLQLEPTDLLLKSKRGNQIHR

SEQ ID NO: 69416 - protein, 552 aa, Homo sapiens
MDRKVAREFRHKVDFLIENDAEKDYLYDVLRMYHQTMDVAVLVGDLKLVINEPSRLPLFDAIRPLIPLKHQVEYDQLTPRRSRKLKEVRLDRLHPEGLGLSVRGGLEFGCGLFISHLIKGGQADSVGLQVGDEIVRINGYSISSCTHEEVINLIRTKKTVSIKVRHIGLIPVKSSPDEPLTWQYVDQFVSESGGVRGSLGSPGNRENKEKKVFISLVGSRGLGCSISSGPIQKPGIFISHVKPGSLSAEVGLEIGDQIVEVNGVDFSNLDHKEAVNVLKSSRSLTISIVAAAGRELFMTDRERLAEARQRELQRQELLMQKRLAMESNKILQEQQEMERQRRKEIAQKAAEENERYRKEMEQIVEEEEKFKKQWEEDWGSKEQLLLPKTITAEVHPVPLRKPKYDQGVEPELEPADDLDGGTEEQGEQDFRKYEEGFDPYSMFTPEQIMGKDVRLLRIKKEGSLDLALEGGVDSPIGKVVVSAVYERGAAERHGGIVKGDEIMAINGKIVTDYTLAEAEAALQKAWNQGGDWIDLVVAVCPPKEYDDELTFF

SEQ ID NO: 69417 - protein, 533 aa, Homo sapiens
MDRKVAREFRHKVDFLIENDAEKDYLYDVLRMYHQTMDVAVLVGDLKLVINEPSRLPLFDAIRPLIPLKHQVEYDQLTPRRSRKLKEVRLDRLHPEGLGLSVRGGLEFGCGLFISHLIKGGQADSVGLQVGDEIVRINGYSISSCTHEEVINLIRTKKTVSIKVRHIGLIPVKSSPDEPLTWQYVDQFVSESGGVRGSLGSPGNRENKEKKVFISLVGSRGLGCSISSGPIQKPGIFISHVKPGSLSAEVGLEIGDQIVEVNGVDFSNLDHKEGRELFMTDRERLAEARQRELQRQELLMQKRLAMESNKILQEQQEMERQRRKEIAQKAAEENERYRKEMEQIVEEEEKFKKQWEEDWGSKEQLLLPKTITAEVHPVPLRKPKYDQGVEPELEPADDLDGGTEEQGEQDFRKYEEGFDPYSMFTPEQIMGKDVRLLRIKKEGSLDLALEGGVDSPIGKVVVSAVYERGAAERHGGIVKGDEIMAINGKIVTDYTLAEAEAALQKAWNQGGDWIDLVVAVCPPKEYDDELTFF

SEQ ID NO: 69418 - protein, 521 aa, Homo sapiens
MYHQTMDVAVLVGDLKLVINEPSRLPLFDAIRPLIPLKHQVEYDQLTPRRSRKLKEVRLDRLHPEGLGLSVRGGLEFGCGLFISHLIKGGQADSVGLQVGDEIVRINGYSISSCTHEEVINLIRTKKTVSIKVRHIGLIPVKSSPDEPLTWQYVDQFVSESGGVRGSLGSPGNRENKEKKVFISLVGSRGLGCSISSGPIQKPGIFISHVKPGSLSAEVGLEIGDQIVEVNGVDFSNLDHKEAVNVLKSSRSLTISIVAAAGRELFMTDRERLAEARQRELQRQELLMQKRLAMESNKILQEQQEMERQRRKEIAQKAAEENERYRKEMEQIVEEEEKFKKQWEEDWGSKEQLLLPKTITAEVHPVPLRKPKYDQGVEPELEPADDLDGGTEEQGEQDFRKYEEGFDPYSMFTPEQIMGKDVRLLRIKKEGSLDLALEGGVDSPIGKVVVSAVYERGAAERHGGIVKGDEIMAINGKIVTDYTLAEAEAALQKAWNQGGDWIDLVVAVCPPKEYDDELTFF

SEQ ID NO: 69419 - protein, 703 aa, Homo sapiens
MSARATRPRSRRGRHAPPGELDPVAESSEEVEAASGSSKPSFAPPPVSSGLEQLGPMEEVSGQGLGSRTDKKMDGGSGRELASAPEVPHKPAVEAHQAPEAALQYKETVPPGNGAPDVFQTLQHTLSSLEAAAAAWRHQPPSHSGPMEFEGTSEGGAGSLGKQEGAGSCQREAARLAERNAWLRLALSSREDELVRTQASLEAIRAEKETLQKEVQELQDSLLRLEPCPHLSHNQAGGSGSGSSSSEADREPWETQDSFSLAHPLLRRLRSHSSTQILGSLPNQPLSPEMHIMEAQMEQLRGSIEKLKCFNRLLSAVLQGYKGRCEGLSMQLGQREAEATALHLALQYSEHCEEAYRVLLALREADSGAGDEAPMSDLQAAEKEAWRLLAQEEAAMDAGAQQNPQPSPEGSSVDKPTPQEVAFQLRSYVQRLQERRSLMKILSEPGPTLAPMPTVPRAEAMVQAILGTQAGPALPRLEKTQIQQDLVAAREALADLMLRLQLVRREKRGLELREAALRALGPAHVLLLEQLRWERAELQAGGANSSGGHSSGGGSSGDEEEWYQGLPAVPGGTSGIDGGQVGRAWDPEKLAQELAASLTRTLDLQEQLQSLRRELEQVAQKGRARRSQSAELNRDLCKAHSALVLAFRGAHRKQEEQRRKLEQQMALMEAQQAEEVAVLEATARALGKPRPPLPPPQLGDTFL

SEQ ID NO: 69420 - protein, 383 aa, Homo sapiens
MSARATRPRSRRGRHAPPGELDPVAESSEEVEAASGSSKPSFAPPPVSSGLEQLGPMEEVSGQGLGSRTDKKMDGGSGRELASAPEVPHKPAVEAHQAPEAALQYKETVPPGNGAPDVFQTLQHTLSSLEAAAAAWRHQPPSHSGPMEFEGTSEGGAGSLGKQEGAGSCQREAARLAERNAWLRLALSSREDELVRTQASLEAIRAEKETLQKEVQELQDSLLRLEPCPHLSHNQAGGSGSGSSSSEADREPWETQDSFSLAHPLLRRLRSHSSTQILGSLPNQPLSPEMHIMEAQMEQLRGSIEKLKCFNRLLSAVLQGYKGRCEGLSMQLGQREAEATALHLALQYRVLLCHPGWSAVVPSWLTATSASPVQVILLPQPPE

SEQ ID NO: 69421 - protein, 639 aa, Homo sapiens
MLHPTDKKMDGGSGRELASAPEVPHKPAVEAHQAPEAALQYKETVPPGNGAPDVFQTLQHTLSSLEAAAAAWRHQPPSHSGPMEFEGTSEGGAGSLGKQEGAGSCQREAARLAERNAWLRLALSSREDELVRTQASLEAIRAEKETLQKEVQELQDSLLRLEPCPHLSHNQAGGSGSGSSSSEADREPWETQDSFSLAHPLLRRLRSHSSTQILGSLPNQPLSPEMHIMEAQMEQLRGSIEKLKCFNRLLSAVLQGYKGRCEGLSMQLGQREAEATALHLALQYSEHCEEAYRVLLALREADSGAGDEAPMSDLQAAEKEAWRLLAQEEAAMDAGAQQNPQPSPEGSSVDKPTPQEVAFQLRSYVQRLQERRSLMKILSEPGPTLAPMPTVPRAEAMVQAILGTQAGPALPRLEKTQIQQDLVAAREALADLMLRLQLVRREKRGLELREAALRALGPAHVLLLEQLRWERAELQAGGANSSGGHSSGGGSSGDEEEWYQGLPAVPGGTSGIDGGQVGRAWDPEKLAQELAASLTRTLDLQEQLQSLRRELEQVAQKGRARRSQSAELNRDLCKAHSALVLAFRGAHRKQEEQRRKLEQQMALMEAQQAEEVAVLEATARALGKPRPPLPPPQLGDTFL

SEQ ID NO: 69422 - protein, 461 aa, Homo sapiens
MNDQYHRAARDGYLELLKEATRKELNAPDEDGMTPTLWAAYHGNLESLRLIVSRGGDPDKCDIWGNTPLHLAASNGHLHCLSFLVSFGANIWCLDNDYHTPLDMAAMKGHMECVRYLDSIAAKQSSLNPKLVGKLKDKAFREAERRIRECAKLQRRHHERMERRYRRELAERSDTLSFSSLTSSTLSRRLQHLALGSHLPYSQATLHGTARGKTKMQKKLERRKQGGEGTFKVSEDGRKSARSLSGLQLGSDVMFVRQGTYANPKEWGRAPLRDMFLSDEDSVSRATLAAEPAHSEVSTDSGHDSLFTRPGLGTMVFRRNYLSSGLHGLGREDGGLDGVGAPRGRLQSSPSLDDDSLGSANSLQDRSCGEELPWDELDLGLDEDLEPETSPLETFLASLHMEDFAALLRQEKIDLEALMLCSDLDLRSISVPLGPRKKILGAVRRRRQAMERPPALEDTEL

SEQ ID NO: 69423 - protein, 5202 aa, Homo sapiens
MNCPVLSLGSGFLFQVIEMLIFAYFASISLTESRGLFPRLENVGAFKKVSIVPTQAVCGLPDRSTFCHSSAAAESIQFCTQRFCIQDCPYRSSHPTYTALFSAGLSSCITPDKNDLHPNAHSNSASFIFGNHKSCFSSPPSPKLMASFTLAVWLKPEQQGVMCVIEKTVDGQIVFKLTISEKETMFYYRTVNGLQPPIKVMTLGRILVKKWIHLSVQVHQTKISFFINGVEKDHTPFNARTLSGSITDFASGTVQIGQSLNGLEQFVGRMQDFRLYQVALTNREILEVFSGDLLRLHAQSHCRCPGSHPRVHPLAQRYCIPNDAGDTADNRVSRLNPEAHPLSFVNDNDVGTSWVSNVFTNITQLNQGVTISVDLENGQYQVFYIIIQFFSPQPTEIRIQRKKENSLDWEDWQYFARNCGAFGMKNNGDLEKPDSVNCLQLSNFTPYSRGNVTFSILTPGPNYRPGYNNFYNTPSLQEFVKATQIRFHFHGQYYTTETAVNLRHRYYAVDEITISGRCQCHGHADNCDTTSQPYRCLCSQESFTEGLHCDRCLPLYNDKPFRQGDQVYAFNCKPCQCNSHSKSCHYNISVDPFPFEHFRGGGGVCDDCEHNTTGRNCELCKDYFFRQVGADPSAIDVCKPCDCDTVGTRNGSILCDQIGGQCNCKRHVSGRQCNQCQNGFYNLQELDPDGCSPCNCNTSGTVDGDITCHQNSGQCKCKANVIGLRCDHCNFGFKFLRSFNDVGCEPCQCNLHGSVNKFCNPHSGQCECKKEAKGLQCDTCRENFYGLDVTNCKACDCDTAGSLPGTVCNAKTGQCICKPNVEGRQCNKCLEGNFYLRQNNSFLCLPCNCDKTGTINGSLLCNKSTGQCPCKLGVTGLRCNQCEPHRYNLTIDNFQHCQMCECDSLGTLPGTICDPISGQCLCVPNRQGRRCNQCQPGFYISPGNATGCLPCSCHTTGAVNHICNSLTGQCVCQDASIAGQRCDQCKDHYFGFDPQTGRCQPCNCHLSGALNETCHLVTGQCFCKQFVTGSKCDACVPSASHLDVNNLLGCSKTPFQQPPPRGQVQSSSAINLSWSPPDSPNAHWLTYSLLRDGFEIYTTEDQYPYSIQYFLDTDLLPYTKYSYYIETTNVHGSTRSVAVTYKTKPGVPEGNLTLSYIIPIGSDSVTLTWTTLSNQSGPIEKYILSCAPLAGGQPCVSYEGHETSATIWNLVPFAKYDFSVQACTSGGCLHSLPITVTTAQAPPQRLSPPKMQKISSTELHVEWSPPAELNGIIIRYELYMRRLRSTKETTSEESRVFQSSGWLSPHSFVESANENALKPPQTMTTITGLEPYTKYEFRVLAVNMAGSVSSAWVSERTGESAPVFMIPPSVFPLSSYSLNISWEKPADNVTRGKVVGYDINMLSEQSPQQSIPMAFSQLLHTAKSQELSYTVEGLKPYRIYEFTITLCNSVGCVTSASGAGQTLAAAPAQLRPPLVKGINSTTIHLRWFPPEELNGPSPIYQLERRESSLPALMTTMMKGIRFIGNGYCKFPSSTHPVNTDFTGIKASFRTKVPEGLIVFAASPGNQEEYFALQLKKGRLYFLFDPQGSPVEVTTTNDHGKQYSDGKWHEIIAIRHQAFGQITLDGIYTGSSAILNGSTVIGDNTGVFLGGLPRSYTILRKDPEIIQKGFVGCLKDVHFMKNYNPSAIWEPLDWQSSEEQINVYNSWEGCPASLNEGAQFLGAGFLELHPYMFHGGMNFEISFKFRTDQLNGLLLFVYNKDGPDFLAMELKSGILTFRLNTSLAFTQVDLLLGLSYCNGKWNKVIIKKEGSFISASVNGLMKHASESGDQPLVVNSPVYVGGIPQELLNSYQHLCLEQGFGGCMKDVKFTRGAVVNLASVSSGAVRVNLDGCLSTDSAVNCRGNDSILVYQGKEQSVYEGGLQPFTEYLYRVIASHEGGSVYSDWSRGRTTGAAPQSVPTPSRVRSLNGYSIEVTWDEPVVRGVIEKYILKAYSEDSTRPPRMPSASAEFVNTSNLTGILTGLLPFKNYAVTLTACTLAGCTESSHALNISTPQEAPQEVQPPVAKSLPSSLLLSWNPPKKANGIITQYCLYMDGRLIYSGSEENYIVTDLAVFTPHQFLLSACTHVGCTNSSWVLLYTAQLPPEHVDSPVLTVLDSRTIHIQWKQPRKISGILERYVLYMSNHTHDFTIWSVIYNSTELFQDHMLQYVLPGNKYLIKLGACTGGGCTVSEASEALTDEDIPEGVPAPKAHSYSPDSFNVSWTEPEYPNGVITSYGLYLDGILIHNSSELSYRAYGFAPWSLHSFRVQACTAKGCALGPLVENRTLEAPPEGTVNVFVKTQGSRKAHVRWEAPFRPNGLLTHSVLFTGIFYVDPVGNNYTLLNVTKVMYSGEETNLWVLIDGLVPFTNYTVQVNISNSQGSLITDPITIAMPPGAPDGVLPPRLSSATPTSLQVVWSTPARNNAPGSPRYQLQMRSGDSTHGFLELFSNPSASLSYEVSDLQPYTEYMFRLVASNGFGSAHSSWIPFMTAEDKPGPVVPPILLDVKSRMMLVTWQHPRKSNGVITHYNIYLHGRLYLRTPGNVTNCTVMHLHPYTAYKFQVEACTSKGCSLSPESQTVWTLPGAPEGIPSPELFSDTPTSVIISWQPPTHPNGLVENFTIERRVKGKEEVTTLVTLPRSHSMRFIDKTSALSPWTKYEYRVLMSTLHGGTNSSAWVEVTTRPSRPAGVQPPVVTVLEPDAVQVTWKPPLIQNGDILSYEIHMPDPHITLTNVTSAVLSQKVTHLIPFTNYSVTIVACSGGNGYLGGCTESLPTYVTTHPTVPQNVGPLSVIPLSESYVVISWQPPSKPNGPNLRYELLRRKIQQPLASNPPEDLNRWHNIYSGTQWLYEDKGLSRFTTYEYMLFVHNSVGFTPSREVTVTTLAGLPERGANLTASVLNHTAIDVRWAKPTVQDLQGEVEYYTLFWSSATSNDSLKILPDVNSHVIGHLKPNTEYWIFISVFNGVHSINSAGLHATTCDGEPQGMLPPEVVIINSTAVRVIWTSPSNPNGVVTEYSIYVNNKLYKTGMNVPGSFILRDLSPFTIYDIQVEVCTIYACVKSNGTQITTVEDTPSDIPTPTIRGITSRSLQIDWVSPRKPNGIILGYDLLWKTWYPCAKTQKLVQDQSDELCKAVRCQKPESICGHICYSSEAKVCCNGVLYNPKPGHRCCEEKYIPFVLNSTGVCCGGRIQEAQPNHQCCSGYYARILPGEVCCPDEQHNRVSVGIGDSCCGRMPYSTSGNQICCAGRLHDGHGQKCCGRQIVSNDLECCGGEEGVVYNRLPGMFCCGQDYVNMSDTICCSASSGESKAHIKKNDPVPVKCCETELIPKSQKCCNGVGYNPLKYVCSDKISTGMMMKETKECRILCPASMEATEHCGRCDFNFTSHICTVIRGSHNSTGKASIEEMCSSAEETIHTGSVNTYSYTDVNLKPYMTYEYRISAWNSYGRGLSKAVRARTKEDVPQGVSPPTWTKIDNLEDTIVLNWRKPIQSNGPIIYYILLRNGIERFRGTSLSFSDKEGIQPFQEYSYQLKACTVAGCATSSKVVAATTQGVPESILPPSITALSAVALHLSWSVPEKSNGVIKEYQIRQVGKGLIHTDTTDRRQHTVTGLQPYTNYSFTLTACTSAGCTSSEPFLGQTLQAAPEGVWVTPRHIIINSTTVELYWSLPEKPNGLVSQYQLSRNGNLLFLGGSEEQNFTDKNLEPNSRYTYKLEVKTGGGSSASDDYIVQTPMSTPEEIYPPYNITVIGPYSIFVAWIPPGILIPEIPVEYNVLLNDGSVTPLAFSVGHHQSTLLENLTPFTQYEIRIQACQNGSCGVSSRMFVKTPEAAPMDLNSPVLKALGSACIEIKWMPPEKPNGIIINYFIYRRPAGIEEESVLFVWSEGALEFMDEGDTLRPFTLYEYRVRACNSKGSVESLWSLTQTLEAPPQDFPAPWAQATSAHSVLLNWTKPESPNGIISHYRVVYQERPDDPTFNSPTVHAFTVKGTSHQAHLYGLEPFTTYRIGVVAANHAGEILSPWTLIQTLESSPSGLRNFIVEQKENGRALLLQWSEPMRTNGVIKTYNIFSDGFLEYSGLNRQFLFRRLDPFTLYTLTLEACTRAGCAHSAPQPLWTDEAPPDSQLAPTVHSVKSTSVELSWSEPVNPNGKIIRYEVIRRCFEGKAWGNQTIQADEKIVFTEYNTERNTFMYNDTGLQPWTQCEYKIYTWNSAGHTCSSWNVVRTLQAPPEGLSPPVISYVSMNPQKLLISWIPPEQSNGIIQSYRLQRNEMLYPFSFDPVTFNYTDEELLPFSTYSYALQACTSGGCSTSKPTSITTLEAAPSEVSPPDLWAVSATQMNVCWSPPTVQNGKITKYLVRYDNKESLAGQGLCLLVSHLQPYSQYNFSLVACTNGGCTASVSKSAWTMEALPENMDSPTLQVTGSESIEITWKPPRNPNGQIRSYELRRDGTIVYTGLETRYRDFTLTPGVEYSYTVTASNSQGGILSPLVKDRTSPSAPSGMEPPKLQARGPQEILVNWDPPVRTNGDIINYTLFIRELFERETKIIHINTTHNSFGMQSYIVNQLKPFHRYEIRIQACTTLGCASSDWTFIQTPEIAPLMQPPPHLEVQMAPGGFQPTVSLLWTGPLQPNGKVLYYELYRRQIATQPRKSNPVLIYNGSSTSFIDSELLPFTEYEYQVWAVNSAGKAPSSWTWCRTGPAPPEGLRAPTFHVISSTQAVVNISAPGKPNGIVSLYRLFSSSAHGAETVLSEGMATQQTLHGLQAFTNYSIGVEACTCFNCCSKGPTAELRTHPAPPSGLSSPQIGTLASRTASFRWSPPMFPNGVIHSYELQFHVACPPDSALPCTPSQIETKYTGLGQKASLGGLQPYTTYKLRVVAHNEVGSTASEWISFTTQKELPQYRAPFSVDSNLSVVCVNWSDTFLLNGQLKEYVLTDGGRRVYSGLDTTLYIPRTADKTFFFQVICTTDEGSVKTPLIQYDTSTGLGLVLTTPGKKKGSRSKSTEFYSELWFIVLMAMLGLILLAIFLSLILQRKIHKEPYIRERPPLVPLQKRMSPLNVYPPGENHMGLADTKIPRSGTPVSIRSNRSACVLRIPSQNQTSLTYSQGSLHRSVSQLMDIQDKKVLMDNSLWEAIMGHNSGLYVDEEDLMNAIKDFSSVTKERTTFTDTHL

SEQ ID NO: 69424 - protein, 1546 aa, Homo sapiens
MNCPVLSLGSGFLFQVIEMLIFAYFASISLTESRGLFPRLENVGAFKKVSIVPTQAVCGLPDRSTFCHSSAAAESIQFCTQRFCIQDCPYRSSHPTYTALFSAGLSSCITPDKNDLHPNAHSNSASFIFGNHKSCFSSPPSPKLMASFTLAVWLKPEQQGVMCVIEKTVDGQIVFKLTISEKETMFYYRTVNGLQPPIKVMTLGRILVKKWIHLSVQVHQTKISFFINGVEKDHTPFNARTLSGSITDFASGTVQIGQSLNGLEQFVGRMQDFRLYQVALTNREILEVFSGDLLRLHAQSHCRCPGSHPRVHPLAQRYCIPNDAGDTADNRVSRLNPEAHPLSFVNDNDVGTSWVSNVFTNITQLNQGVTISVDLENGQYQVFYIIIQFFSPQPTEIRIQRKKENSLDWEDWQYFARNCGAFGMKNNGDLEKPDSVNCLQLSNFTPYSRGNVTFSILTPGPNYRPGYNNFYNTPSLQEFVKATQIRFHFHGQYYTTETAVNLRHRYYAVDEITISGRCQCHGHADNCDTTSQPYRCLCSQESFTEGLHCDRCLPLYNDKPFRQGDQVYAFNCKPCQCNSHSKSCHYNISVDPFPFEHFRGGGGVCDDCEHNTTGRNCELCKDYFFRQVGADPSAIDVCKPCDCDTVGTRNGSILCDQIGGQCNCKRHVSGRQCNQCQNGFYNLQELDPDGCSPCNCNTSGTVDGDITCHQNSGQCKCKANVIGLRCDHCNFGFKFLRSFNDVGCEPCQCNLHGSVNKFCNPHSGQCECKKEAKGLQCDTCRENFYGLDVTNCKACDCDTAGSLPGTVCNAKTGQCICKPNVEGRQCNKCLEGNFYLRQNNSFLCLPCNCDKTGTINGSLLCNKSTGQCPCKLGVTGLRCNQCEPHRYNLTIDNFQHCQMCECDSLGTLPGTICDPISGQCLCVPNRQGRRCNQCQPGFYISPGNATGCLPCSCHTTGAVNHICNSLTGQCVCQDASIAGQRCDQCKDHYFGFDPQTGRCQPCNCHLSGALNETCHLVTGQCFCKQFVTGSKCDACVPSASHLDVNNLLGCSKTPFQQPPPRGQVQSSSAINLSWSPPDSPNAHWLTYSLLRDGFEIYTTEDQYPYSIQYFLDTDLLPYTKYSYYIETTNVHGSTRSVAVTYKTKPGVPEGNLTLSYIIPIGSDSVTLTWTTLSNQSGPIEKYILSCAPLAGGQPCVSYEGHETSATIWNLVPFAKYDFSVQACTSGGCLHSLPITVTTAQAPPQRLSPPKMQKISSTELHVEWSPPAELNGIIIRYELYMRRLRSTKETTSEESRVFQSSGWLSPHSFVESANENALKPPQTMTTITGLEPYTKYEFRVLAVNMAGSVSSAWVSERTGESAPVFMIPPSVFPLSSYSLNISWEKPADNVTRGKVVGYDINMLSEQSPQQSIPMAFSQLLHTAKSQELSYTVEGLKPYRIYEFTITLCNSVGCVTSASGAGQTLAAAPAQLRPPLVKGINSTTIHLRWFPPEELNGPSPIYQLERRESSLPALMTTMMKGIRFIGNGYCKFPSSTHPVNTDFTGKCV

SEQ ID NO: 69425 - protein, 5226 aa, Homo sapiens
MNCPVLSLGSGFLFQVIEMLIFAYFASISLTESRGLFPRLENVGAFKKVSIVPTQAVCGLPDRSTFCHSSAAAESIQFCTQRFCIQDCPYRSSHPTYTALFSAGLSSCITPDKNDLHPNAHSNSASFIFGNHKSCFSSPPSPKLMASFTLAVWLKPEQQGVMCVIEKTVDGQIVFKLTISEKETMFYYRTVNGLQPPIKVMTLGRILVKKWIHLSVQVHQTKISFFINGVEKDHTPFNARTLSGSITDFASGTVQIGQSLNGLEQFVGRMQDFRLYQVALTNREILEVFSGDLLRLHAQSHCRCPGSHPRVHPLAQRYCIPNDAGDTADNRVSRLNPEAHPLSFVNDNDVGTSWVSNVFTNITQLNQGVTISVDLENGQYQVFYIIIQFFSPQPTEIRIQRKKENSLDWEDWQYFARNCGAFGMKNNGDLEKPDSVNCLQLSNFTPYSRGNVTFSILTPGPNYRPGYNNFYNTPSLQEFVKATQIRFHFHGQYYTTETAVNLRHRYYAVDEITISGRCQCHGHADNCDTTSQPYRCLCSQESFTEGLHCDRCLPLYNDKPFRQGDQVYAFNCKPCQCNSHSKSCHYNISVDPFPFEHFRGGGGVCDDCEHNTTGRNCELCKDYFFRQVGADPSAIDVCKPCDCDTVGTRNGSILCDQIGGQCNCKRHVSGRQCNQCQNGFYNLQELDPDGCSPCNCNTSGTVDGDITCHQNSGQCKCKANVIGLRCDHCNFGFKFLRSFNDVGCEPCQCNLHGSVNKFCNPHSGQCECKKEAKGLQCDTCRENFYGLDVTNCKACDCDTAGSLPGTVCNAKTGQCICKPNVEGRQCNKCLEGNFYLRQNNSFLCLPCNCDKTGTINGSLLCNKSTGQCPCKLGVTGLRCNQCEPHRYNLTIDNFQHCQMCECDSLGTLPGTICDPISGQCLCVPNRQGRRCNQCQPGFYISPGNATGCLPCSCHTTGAVNHICNSLTGQCVCQDASIAGQRCDQCKDHYFGFDPQTGRCQPCNCHLSGALNETCHLVTGQCFCKQFVTGSKCDACVPSASHLDVNNLLGCSKTPFQQPPPRGQVQSSSAINLSWSPPDSPNAHWLTYSLLRDGFEIYTTEDQYPYSIQYFLDTDLLPYTKYSYYIETTNVHGSTRSVAVTYKTKPGVPEGNLTLSYIIPIGSDSVTLTWTTLSNQSGPIEKYILSCAPLAGGQPCVSYEGHETSATIWNLVPFAKYDFSVQACTSGGCLHSLPITVTTAQAPPQRLSPPKMQKISSTELHVEWSPPAELNGIIIRYELYMRRLRSTKETTSEESRVFQSSGWLSPHSFVESANENALKPPQTMTTITGLEPYTKYEFRVLAVNMAGSVSSAWVSERTGESAPVFMIPPSVFPLSSYSLNISWEKPADNVTRGKVVGYDINMLSEQSPQQSIPMAFSQLLHTAKSQELSYTVEGLKPYRIYEFTITLCNSVGCVTSASGAGQTLAAAPAQLRPPLVKGINSTTIHLRWFPPEELNGPSPIYQLERRESSLPALMTTMMKGIRFIGNGYCKFPSSTHPVNTDFTGIKASFRTKVPEGLIVFAASPGNQEEYFALQLKKGRLYFLFDPQGSPVEVTTTNDHGKQYSDGKWHEIIAIRHQAFGQITLDGIYTGSSAILNGSTVIGDNTGVFLGGLPRSYTILRKDPEIIQKGFVGCLKDVHFMKNYNPSAIWEPLDWQSSEEQINVYNSWEGCPASLNEGAQFLGAGFLELHPYMFHGGMNFEISFKFRTDQLNGLLLFVYNKDGPDFLAMELKSGILTFRLNTSLAFTQVDLLLGLSYCNGKWNKVIIKKEGSFISASVNGLMKHASESGDQPLVVNSPVYVGGIPQELLNSYQHLCLEQGFGGCMKDVKFTRGAVVNLASVSSGAVRVNLDGCLSTDSAVNCRGNDSILVYQGKEQSVYEGGLQPFTEYLYRVIASHEGGSVYSDWSRGRTTGAAPQSVPTPSRVRSLNGYSIEVTWDEPVVRGVIEKYILKAYSEDSTRPPRMPSASAEFVNTSNLTGILTGLLPFKNYAVTLTACTLAGCTESSHALNISTPQEAPQEVQPPVAKSLPSSLLLSWNPPKKANGIITQYCLYMDGRLIYSGSEENYIVTDLAVFTPHQFLLSACTHVGCTNSSWVLLYTAQLPPEHVDSPVLTVLDSRTIHIQWKQPRKISGILERYVLYMSNHTHDFTIWSVIYNSTELFQDHMLQYVLPGNKYLIKLGACTGGGCTVSEASEALTDEDIPEGVPAPKAHSYSPDSFNVSWTEPEYPNGVITSYGLYLDGILIHNSSELSYRAYGFAPWSLHSFRVQACTAKGCALGPLVENRTLEAPPEGTVNVFVKTQGSRKAHVRWEAPFRPNGLLTHSVLFTGIFYVDPVGNNYTLLNVTKVMYSGEETNLWVLIDGLVPFTNYTVQVNISNSQGSLITDPITIAMPPGAPDGVLPPRLSSATPTSLQVVWSTPARNNAPGSPRYQLQMRSGDSTHGFLELFSNPSASLSYEVSDLQPYTEYMFRLVASNGFGSAHSSWIPFMTAEDKPGPVVPPILLDVKSRMMLVTWQHPRKSNGVITHYNIYLHGRLYLRTPGNVTNCTVMHLHPYTAYKFQVEACTSKGCSLSPESQTVWTLPGAPEGIPSPELFSDTPTSVIISWQPPTHPNGLVENFTIERRVKGKEEVTTLVTLPRSHSMRFIDKTSALSPWTKYEYRVLMSTLHGGTNSSAWVEVTTRPSRPAGVQPPVVTVLEPDAVQVTWKPPLIQNGDILSYEIHMPDPHITLTNVTSAVLSQKVTHLIPFTNYSVTIVACSGGNGYLGGCTESLPTYVTTHPTVPQNVGPLSVIPLSESYVVISWQPPSKPNGPNLRYELLRRKIQQPLASNPPEDLNRWHNIYSGTQWLYEDKGLSRFTTYEYMLFVHNSVGFTPSREVTVTTLAGLPERGANLTASVLNHTAIDVRWAKPTVQDLQGEVEYYTLFWSSATSNDSLKILPDVNSHVIGHLKPNTEYWIFISVFNGVHSINSAGLHATTCDGEPQGMLPPEVVIINSTAVRVIWTSPSNPNGVVTEYSIYVNNKLYKTGMNVPGSFILRDLSPFTIYDIQVEVCTIYACVKSNGTQITTVEDTPSDIPTPTIRGITSRSLQIDWVSPRKPNGIILGYDLLWKTWYPCAKTQKLVQDQSDELCKAVRCQKPESICGHICYSSEAKVCCNGVLYNPKPGHRCCEEKYIPFVLNSTGVCCGGRIQEAQPNHQCCSGYYARILPGEVCCPDEQHNRVSVGIGDSCCGRMPYSTSGNQICCAGRLHDGHGQKCCGRQIVSNDLECCGGEEGVVYNRLPGMFCCGQDYVNMSDTICCSASSGESKAHIKKNDPVPVKCCETELIPKSQKCCNGVGYNPLKYVCSDKISTGMMMKETKECRILCPASMEATEHCGRCDFNFTSHICTVIRGSHNSTGKASIEEMCSSAEETIHTGSVNTYSYTDVNLKPYMTYEYRISAWNSYGRGLSKAVRARTKEDVPQGVSPPTWTKIDNLEDTIVLNWRKPIQSNGPIIYYILLRNGIERFRGTSLSFSDKEGIQPFQEYSYQLKACTVAGCATSSKVVAATTQGVPESILPPSITALSAVALHLSWSVPEKSNGVIKEYQIRQVGKGLIHTDTTDRRQHTVTGLQPYTNYSFTLTACTSAGCTSSEPFLGQTLQAAPEGVWVTPRHIIINSTTVELYWSLPEKPNGLVSQYQLSRNGNLLFLGGSEEQNFTDKNLEPNSRYTYKLEVKTGGGSSASDDYIVQTPMSTPEEIYPPYNITVIGPYSIFVAWIPPGILIPEIPVEYNVLLNDGSVTPLAFSVGHHQSTLLENLTPFTQYEIRIQACQNGSCGVSSRMFVKTPEAAPMDLNSPVLKALGSACIEIKWMPPEKPNGIIINYFIYRRPAGIEEESVLFVWSEGALEFMDEGDTLRPFTLYEYRVRACNSKGSVESLWSLTQTLEAPPQDFPAPWAQATSAHSVLLNWTKPESPNGIISHYRVVYQERPDDPTFNSPTVHAFTVKGTSHQAHLYGLEPFTTYRIGVVAANHAGEILSPWTLIQTLESSPSGLRNFIVEQKENGRALLLQWSEPMRTNGVIKTYNIFSDGFLEYSGLNRQFLFRRLDPFTLYTLTLEACTRAGCAHSAPQPLWTDEAPPDSQLAPTVHSVKSTSVELSWSEPVNPNGKIIRYEVIRRCFEGKAWGNQTIQADEKIVFTEYNTERNTFMYNDTGLQPWTQCEYKIYTWNSAGHTCSSWNVVRTLQAPPEGLSPPVISYVSMNPQKLLISWIPPEQSNGIIQSYRLQRNEMLYPFSFDPVTFNYTDEELLPFSTYSYALQACTSGGCSTSKPTSITTLEAAPSEVSPPDLWAVSATQMNVCWSPPTVQNGKITKYLVRYDNKESLAGQGLCLLVSHLQPYSQYNFSLVACTNGGCTASVSKSAWTMEALPENMDSPTLQVTGSESIEITWKPPRNPNGQIRSYELRRDGTIVYTGLETRYRDFTLTPGVEYSYTVTASNSQGGILSPLVKDRTSPSAPSGMEPPKLQARGPQEILVNWDPPVRTNGDIINYTLFIRELFERETKIIHINTTHNSFGMQSYIVNQLKPFHRYEIRIQACTTLGCASSDWTFIQTPEIAPLMQPPPHLEVQMAPGGFQPTVSLLWTGPLQPNGKVLYYELYRRQIATQPRKSNPVLIYNGSSTSFIDSELLPFTEYEYQVWAVNSAGKAPSSWTWCRTGPAPPEGLRAPTFHVISSTQAVVNISAPGKPNGIVSLYRLFSSSAHGAETVLSEGMATQQTLHGLQAFTNYSIGVEACTCFNCCSKGPTAELRTHPAPPSGLSSPQIGTLASRTASFRWSPPMFPNGVIHSYELQFHVACPPDSALPCTPSQIETKYTGLGQKASLGGLQPYTTYKLRVVAHNEVGSTASEWISFTTQKELPQYRAPFSVDSNLSVVCVNWSDTFLLNGQLKEYVLTDGGRRVYSGLDTTLYIPRTADKTFFFQVICTTDEGSVKTPLIQYDTSTGLGLVLTTPGKKKGSRSKSTEFYSELWFIVLMAMLGLILLAIFLSLILQRKIHKEPYIRERPPLVPLQKRMSPLNVYPPGENHMFDSVADISDVSSNVTLKSYTMHFEGLADTKIPRSGTPVSIRSNRSACVLRIPSQNQTSLTYSQGSLHRSVSQLMDIQDKKVLMDNSLWEAIMGHNSGLYVDEEDLMNAIKDFSSVTKERTTFTDTHL

SEQ ID NO: 69426 - protein, 845 aa, Homo sapiens
MRTEAVVNSQGQTDYLTKDSDQDVALKLAQERAEIVAKYDRGREGAEIEPWEDADYLVYKVTDRFGFLHEEELPDHNVAVERQKHLEIERTTKWLKMLKGWEKYKNTEKFHRRIYKGIPLQLRGEVWALLLEIPKMKEETRDLYSKLKHRARGCSPDIRQIDLDVNRTFRDHIMFRDRYGVKQQSLFHVLAAYSIYNTEVGYCQGMSQITALLLMYMNEEDAFWALVKLFSGPKHAMHGFFVQGFPKLLRFQEHHEKILNKFLSKLKQHLDSQEIYTSFYTMKWFFQCFLDRTPFTLNLRIWDIYIFEGERVLTAMSYTILKLHKKHLMKLSMEELVEFFQETLAKDFFFEDDFVIEQLQISMTELKRAKLDLPEPGKEDEYPKKPLGQLPPELQSWGVHHLSNGQRSVGRPSPLASGRRESGAPHRRHEHSPHPQSRTGTPERAQPPRRKSVEEESKKLKDEADFQRKLPSGPQDSSRQYNHAAANQNSNATSNIRKEFVPKWNKPSDVSATERTAKYTMEGKGRAAHPALAVTVPGPAEVRVSNVRPKMKALDAEDGKRGSTASQYDNVPGPELDSGASVEEALERAYSQSPRHALYPPSPRKHAEPSSSPSKVSNKFTFKVQPPSHARYPSQLDGEARGLAHPPSYSNPPVYHGNSPKHFPTANSSFASPQFSPGTQLNPSRRPHGSTLSVSASPEKSYSRPSPLVLPSSRIEVLPVDTGAGGYSGNSGSPKNGKLIIPPVDYLPDNRTWSEVSYTYRPETQGQSWTRDASRGNLPKYSAFQLAPFQDHGLPAVSVDSPVRYKASPAAEDASPSGYPYSGPPPPAYHYRNRDGLSIQESVLL

SEQ ID NO: 69427 - protein, 828 aa, Homo sapiens
MNSDQDVALKLAQERAEIVAKYDRGREGAEIEPWEDADYLVYKVTDRFGFLHEEELPDHNVAVERQKHLEIERTTKWLKMLKGWEKYKNTEKFHRRIYKGIPLQLRGEVWALLLEIPKMKEETRDLYSKLKHRARGCSPDIRQIDLDVNRTFRDHIMFRDRYGVKQQSLFHVLAAYSIYNTEVGYCQGMSQITALLLMYMNEEDAFWALVKLFSGPKHAMHGFFVQGFPKLLRFQEHHEKILNKFLSKLKQHLDSQEIYTSFYTMKWFFQCFLDRTPFTLNLRIWDIYIFEGERVLTAMSYTILKLHKKHLMKLSMEELVEFFQETLAKDFFFEDDFVIEQLQISMTELKRAKLDLPEPGKEDEYPKKPLGQLPPELQSWGVHHLSNGQRSVGRPSPLASGRRESGAPHRRHEHSPHPQSRTGTPERAQPPRRKSVEEESKKLKDEADFQRKLPSGPQDSSRQYNHAAANQNSNATSNIRKEFVPKWNKPSDVSATERTAKYTMEGKGRAAHPALAVTVPGPAEVRVSNVRPKMKALDAEDGKRGSTASQYDNVPGPELDSGASVEEALERAYSQSPRHALYPPSPRKHAEPSSSPSKVSNKFTFKVQPPSHARYPSQLDGEARGLAHPPSYSNPPVYHGNSPKHFPTANSSFASPQFSPGTQLNPSRRPHGSTLSVSASPEKSYSRPSPLVLPSSRIEVLPVDTGAGGYSGNSGSPKNGKLIIPPVDYLPDNRTWSEVSYTYRPETQGQSWTRDASRGNLPKYSAFQLAPFQDHGLPAVSVDSPVRYKASPAAEDASPSGYPYSGPPPPAYHYRNRDGLSIQESVLL

SEQ ID NO: 69428 - protein, 828 aa, Homo sapiens; identical to SEQ ID NO: 69427

SEQ ID NO: 69429 - protein, 253 aa, Homo sapiens
MAAAFRKAAKSRQREHRERSQPGFRKHLGLLEKKKDYKLRADDYRKKQEYLKALRKKALEKNPDEFYYKMTRVKLQDGVHIIKETKEEVTPEQLKLMRTQDVKYIEMKRVAEAKKIERLKSELHLLDFQGKQQNKHVFFFDTKKEVEQFDVATHLQTAPELVDRVFNRPRIETLQKEKVKGVTNQTGLKRIAKERQKQYNCLTQRIEREKKLFVIAQKIQTRKDLMDKTQKVKVKKETVNSPAIYKFQSRRKR

SEQ ID NO: 69430 - protein, 148 aa, Homo sapiens
MAAAFRKAAKSRQREHRERSQPGFRKHLGLLEKKKDYKLRADDYRKKQEYLKALRKKALEKNPDEFYYKMTRVKLQDGVHIIKETKEEVTPEQLKLMRTQDVKYIEMKRVAEAKKIERLKSELHLLDFQGKQQNKHVFFFDTKKEANS

SEQ ID NO: 69431 - protein, 556 aa, Homo sapiens
MPPERRRRMKLDRRTGAKPKRKPGMRPDWKAGAGPGGPPQKPAPSSQRKPPARPSAAAAAIAVAAAEEERRLRQRNRLRLEEDKPAVERCLEELVFGDVENDEDALLRRLRGPRVQEHEDSGDSEVENEAKGNFPPQKKPVWVDEEDEDEEMVDMMNNRFRKDMMKNASESKLSKDNLKKRLKEEFQHAMGGVPAWAETTKRKTSSDDESEEDEDDLLQRTGNFISTSTSLPRGILKMKNCQHANAERPTVARISSVQFHPGAQIVMVAGLDNAVSLFQVDGKTNPKIQSIYLERFPIFKACFSANGEEVLATSTHSKVLYVYDMLAGKLIPVHQVRGLKEKIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLVHLPSCTVFSNFPVIKNKNISHVHTMDFSPRSGYFALGNEKGKALMYRLHHYSDF

SEQ ID NO: 69432 - protein, 521 aa, Homo sapiens
MRPDWKAGAGPGGPPQKPAPSSQRKPPARPSAAAAAIAVAAAEEERRLRQRNRLRLEEDKPAVERCLEELVFGDVENDEDALLRRLRGPRVQEHEDSGDSEVENEAKGNFPPQKKPVWVDEEDEDEEMVDMMNNRFRKDMMKNASESKLSKDNLKKRLKEEFQHAMGGVPAWAETTKRKTSSDDESEEDEDDLLQRTGNFISTSTSLPRGILKMKNCQHANAERPTVARISSVQFHPGAQIVMVAGLDNAVSLFQVDGKTNPKIQSIYLERFPIFKACFSANGEEVLATSTHSKVLYVYDMLAGKLIPVHQVRGLKEKIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLVHLPSCTVFSNFPVIKNKNISHVHTMDFSPRSGYFALGNEKARP

SEQ ID NO: 69433 - protein, 2785 aa, Homo sapiens
MKTKPVSHKTENTYRFLTFAERLGNVNIDIIHRIDRTASYEEEVETYFFEGLLKWRELNLTEHFGKFYKEVIDKCQSFNQLVYHQNEIVQSLKTHLQVKNSFAYQPLLDLVVQLARDLQMDFYPHFPEFFLTITSILETQDTELLEWAFTSLSYLYKYLWRLMVKDMSSIYSMYSTLLAHKKLHIRNFAAESFTFLMRKVSDKNALFNLMFLDLDKHPEKVEGVGQLLFEMCKGVRNMFHSCTGQAVKLILRKLGPVTETETQLPWMLIGETLKNMVKSTVSYISKEHFGTFFECLQESLLDLHTKVTKTNCCESSEQIKRLLETYLILVKHGSGTKIPTPADVCKVLSQTLQVASLSTSCWETLLDVISALILGENVSLPETLIKETIEKIFESRFEKRLIFSFSEVMFAMKQFEQLFLPSFLSYIVNCFLIDDAVVKDEALAILAKLILNKAAPPTAGSMAIEKYPLVFSPQMVGFYIKQKKTRSKGRNEQFPVLDHLLSIIKLPPNKDTTYLSQSWAALVVLPHIRPLEKEKVIPLVTGFIEALFMTVDKGSFGKGNLFVLCQAVNTLLSLEESSELLHLVPVERVKNLVLTFPLEPSVLLLTDLYYQRLALCGCKGPLSQEALMELFPKLQANISTGVSKIRLLTIRILNHFDVQLPESMEDDGLSERQSVFAILRQAELVPATVNDYREKLLHLRKLRHDVVQTAVPDGPLQEVPLRYLLGMLYINFSALWDPVIELISSHAHEMENKQFWKVYYEHLEKAATHAEKELQNDMTDEKSVGDESWEQTQEGDVGALYHEQLALKTDCQERLDHTNFRFLLWRALTKFPERVEPRSRELSPLFLRFINNEYYPADLQVAPTQDLRRKGKGMVAEEIEEEPAAGDDEELEEEAVPQDESSQKKKTRRAAAKQLIAHLQVFSKFSNPRALYLESKLYELYLQLLLHQDQMVQKITLDCIMTYKHPHVLPYRENLQRLLEDRSFKEEIVHFSISEDNAVVKTAHRADLFPILMRILYGRMKNKTGSKTQGKSASGTRMAIVLRFLAGTQPEEIQIFLDLLFEPVRHFKNGECHSAVIQAVEDLDLSKVLPLGRQHGILNSLEIVLKNISHLISAYLPKILQILLCMTATVSHILDQREKIQLRFINPLKNLRRLGIKMVTDIFLDWESYQFRTEEIDAVFHGAVWPQISRLGSESQYSPTPLLKLISIWSRNARYFPLLAKQKPGHPECDILTNVFAILSAKNLSDATASIVMDIVDDLLNLPDFEPTETVLNLLVTGCVYPGIAENIGESITIGGRLILPHVPAILQYLSKTTISAEKVKKKKNRAQVSKELGILSKISKFMKDKEQSSVLITLLLPFLHRGNIAEDTEVDILVTVQNLLKHCVDPTSFLKPIAKLFSVIKNKLSRKLLCTVFETLSDFESGLKYITDVVKLNAFDQRHLDDINFDVRFETFQTITSYIKEMQIVDVNYLIPVMHNCFYNLELGDMSLSDNASMCLMSIIKKLAALNVTEKDYREIIHRSLLEKLRKGLKSQTESIQQDYTTILSCLIQTFPNQLEFKDLVQLTHYHDPEMDFFENMKHIQIHRRARALKKLAKQLMEGKVVLSSKSLQNYIMPYAMTPIFDEKMLKHENITTAATEIIGAICKHLSWSAYMYYLKHFIHVLQTGQINQKLGVSLLVIVLEAFHFDHKTLEEQMGKIENEENAIEAIELPEPEAMELERVDEEEKEYTCKSLSDNGQPGTPDPADSGGTSAKESECITKPVSFLPQNKEEIERTIKNIQGTITGDILPRLHKCLASTTKREEEHKLVKSKVVNDEEVVRVPLAFAMVKLMQSLPQEVMEANLPSILLKVCALLKNRAQEIRDIARSTLAKIIEDLGVHFLLYVLKELQTTLVRGYQVHVLTFTVHMLLQGLTNKLQVGDLDSCLDIMIEIFNHELFGAVAEEKEVKQILSKVMEARRSKSYDSYEILGKFVGKDQVTKLILPLKEILQNTTSLKLARKVHETLRRITVGLIVNQEMTAESILLLSYGLISENLPLLTEKEKNPVAPAPDPRLPPQSCLLLPPTPVRGGQKAVVSRKTNMHIFIESGLRLLHLSLKTSKIKSSGECVLEMLDPFVSLLIDCLGSMDVKVITGALQCLIWVLRFPLPSIETKAEQLTKHLFLLLKDYAKLGAARGQNFHLVVNCFKCVTILVKKVKSYQITEKQLQVLLAYAEEDIYDTSRQATAFGLLKAILSRKLLVPEIDEVMRKVSKLAVSAQSEPARVQCRQVFLKYILDYPLGDKLRPNLEFMLAQLNYEHETGRESTLEMIAYLFDTFPQGLLHENCGMFFIPLCLMTINDDSATCKKMASMTIKSLLGKISLEKKDWLFDMVTTWFGAKKRLNRQLAALICGLFVESEGVDFEKRLGTVLPVIEKEIDPENFKDIMEETEEKAADRLLFSFLTLITKLIKECNIIQFTKPAETLSKIWSHVHSHLRHPHNWVWLTAAQIFGLLFASCQPEELIQKWNTKKTKKHLPEPVAIKFLASDLDQKMKSISLASCHQLHSKFLDQSLGEQVVKNLLFAAKVLYLLELYCEDKQSKIKEDLEEQEALEDGVACADEKAESDGEEKEEVKEELGRPATLLWLIQKLSRIAKLEAAYSPRNPLKRTCIFKFLGAVAMDLGIDKVKPYLPMIIAPLFRELNSTYSEQDPLLKNLSQEIIELLKKLVGLESFSLAFASVQKQANEKRALRKKRKALEFVTNPDIAAKKKMKKHKNKSEAKKRKIEFLRPGYKAKRQKSHSLKDLAMVE

SEQ ID NO: 69434 - protein, 479 aa, Homo sapiens
MVGRSRRRGAAKWAAVRAKAGPTLTDENGDDLGLPPSPGDTSYYQDQVDDFHEARSRAALAKGWNEVQSGDEEDGEEEEEEVLALDMDDEDDEDGGNAGEEEEEENADDDGGSSVQSEAEASVDPSLSWGQRKKLYYDTDYGSKSRGRQSQQEAEEEEREEEEEAQIIQRRLAQALQEDDFGVAWVEAFAKPVPQVDEAETRVVKDLAKVSVKEKLKMLRKESPELLELIEDLKVKLTEVKDELEPLLELVEQGIIPPGKGSQYLRTKYNLYLNYCSNISFYLILKARRVPAHGHPVIERLVTYRNLINKLSVVDQKLSSEIRHLLTLKDDAVKKELIPKAKSTKPKPKSVSKTSAAACAVTDLSDDSDFDEKAKLKYYKEIEDRQKLKRKKEENSTEEQALEDQNAKRAITYQIAKNRGLTPRRKKIDRNPRVKHREKFRRAKIRRRGQVREVRKEEQRYSGELSGIRAGVKKSIKLK

SEQ ID NO: 69435 - protein, 251 aa, Homo sapiens
  MOD_RES (1)..(1): Any amino acid
XIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPSQSPQLFHDDTHSRIEQYATRLAQMERTNGSFLTDSSSTTG

SEQ ID NO: 69436 - protein, 66 aa, Homo sapiens
MIGLNFNLRELLTKFEKDIQAEIDAHNDIFKSIDGNRQKMVKALGNSEEATMLQHRLDDMNQRWND

SEQ ID NO: 69437 - protein, 988 aa, Homo sapiens
MQILRCLQKCGKLKMMAVVRTSLQKVVVLLHRLQRMAVSSPRYQKLCKDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 69438 - protein, 1022 aa, Homo sapiens
MAKYGEHEASPDNGQNEFSDIIKSRSDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFE

SEQ ID NO: 69439 - protein, 3433 aa, Homo sapiens
MAKYGEHEASPDNGQNEFSDIIKSRSDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTLAQNLKNKASSSDMRTAITEKLERVKNQWDGTQHGVELRQQQLEDMIIDSLQWDDHREETEELMRKYEARLYILQQARRDPLTKQISDNQILLQELGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 69440 - protein, 184 aa, Homo sapiens
MHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPSQSPQLFHDDTHSRIEQYATRLAQMERTNGSFLTDSSSTTGSVEDEHALIQQYCQTLGG

SEQ ID NO: 69441 - protein, 153 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVDVMKDVMSDLQQ

SEQ ID NO: 69442 - protein, 181 aa, Homo sapiens
MHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSV

SEQ ID NO: 69443 - protein, 47 aa, Homo sapiens
MAKYGEHEASPDNGQNEFSDIIKSRSDEHNDVQKKTFTKWINARFSK

SEQ ID NO: 69444 - protein, 186 aa, Homo sapiens
MLEEEEWYRSLKHFNYDVCQSCFFSGRTAKGHKLHYPMVEYCIPTTSGEDVRDFTKVLKNKFRSKKYFAKHPRLGYLPVQTVLEGDNLETPSQSPQLFHDDTHSRIEQYATRLAQMERTNGSFLTDSSSTTGSVEDEHALIQQYCQTLGGESPVSQPQSPAQILKSVEREERGELERIIADLEEEQ

SEQ ID NO: 69445 - protein, 66 aa, Homo sapiens; identical to SEQ ID NO: 69436

SEQ ID NO: 69446 - protein, 184 aa, Homo sapiens; identical to SEQ ID NO: 69440

SEQ ID NO: 69447 - protein, 699 aa, Homo sapiens
MSASASVGGPVPQPPPGPAAALPPGSAARALHVELPSQQRRLRHLRNIAARNIVNRNGHQLLDTYFTLHLCSTEKIYKEFYRSEVIKNSLNPTWRSLDFGIMPDRLDTSVSCFVVKIWGGKENIYQLLIEWKVCLDGLKYLGQQIHARNQNEIIFGLNDGYYGAPFEHKGYSNAQKTILLQVDQNCVRNSYDVFSLLRLHRAQCAIKQTQVTVQKIGKEIEEKLRLTSTSNELKKKSECLQLKILVLQNELERQKKALGREVALLHKQQIALQDKGSAFSAEHLKLQLQKESLNELRKECTAKRELFLKTNAQLTIRCRQLLSELSYIYPIDLNEHKDYFVCGVKLPNSEDFQAKDDGSIAVALGYTAHLVSMISFFLQVPLRYPIIHKGSRSTIKDNINDKLTEKEREFPLYPKGGEKLQFDYGVYLLNKNIAQLRYQHGLGTPDLRQTLPNLKNFMEHGLMVRCDRHHTSSAIPVPKRQSSIFGGADVGFSGGIPSPDKGHRKRASSENERLQYKTPPPSYNSALAQPVTTVPSMGETERKITSLSSSLDTSLDFSKENKKKGEDLVGSLNGGHANVHPSQEQGEALSGHRATVNGTLLPSEQAGSASVQLPGEFHPVSEAELCCTVEQAEEIIGLEATGFASGDQLEAFNCIPVDSAVAVECDEQVLGEFEEFSRRIYALNENVSSFRRPRRSSDK

SEQ ID NO: 69448 - protein, 255 aa, Homo sapiens
MFISVAQRQRENAFSCSTFLRCDRHHTSSAIPVPKRQSSIFGGADVGFSGGIPSPDKGHRKRASSENERLQYKTPPPSYNSALAQPVTTVPSMGETERKITSLSSSLDTSLDFSKENKKKGEDLVGSLNGGHANVHPSQEQGEALSGHRATVNGTLLPSEQAGSASVQLPGEFHPVSEAELCCTVEQAEEIIGLEATGFASGDQLEAFNCIPVDSAVAVECDEQVLGEFEEFSRRIYALNENVSSFRRPRRSSDK

SEQ ID NO: 69449 - protein, 327 aa, Homo sapiens
MISFFLQVPLRYPIIHKGSRSTIKDNINDKLTEKEREFPLYPKGGEKLQFDYGVYLLNKNIAQLRYQHGLGTPDLRQTLPNLKNFMEHGLMVRCDRHHTSSAIPVPKRQSSIFGGADVGFSGGIPSPDKGHRKRASSENERLQYKTPPPSYNSALAQPVTTVPSMGETERKITSLSSSLDTSLDFSKENKKKGEDLVGSLNGGHANVHPSQEQGEALSGHRATVNGTLLPSEQAGSASVQLPGEFHPVSEAELCCTVEQAEEIIGLEATGFASGDQLEAFNCIPVDSAVAVECDEQVLGEFEEFSRRIYALNENVSSFRRPRRSSDK

SEQ ID NO: 69450 - protein, 1416 aa, Homo sapiens
MKSLKSRLRRQDVPGPASSGAAAASAHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVDGRTPLVLATQMSRPTICQLLIDRGADVNSRDKQNRTALMLGCEYGCRDAVEVLIKNGADISLLDALGHDSSYYARIGDNLDILTLLKTASENTNKGRELWKKGPSLQQRNLTHMQDEVNVKSHQREHQNIQDLEIENEDLKERLRKIQQEQRILLDKVNGLQLQLNEEVMVADDLESEREKLKSLLAAKEKQHEESLRTIEALKNRFKYFESDHLGSGSHFSNRKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEENKRLQKELSMCEMEREKKGRKVTEMEGQAKELSAKLALSIPAEKFENMKSSLSNEVNEKAKKLVEMEREHEKSLSEIRQLKRELENVKAKLAQHVKPEEHEQVKSRLEQKSGELGKKITELTLKNQTLQKEIEKVYLDNKLLKEQAHNLTIEMKNHYVPLKVSEDMKKSHDAIIDDLNRKLLDVTQKYTEKKLEMEKLLLENDSLSKDVSRLETVFVPPEKHEKEIIALKSNIVELKKQLSELKKKCGEDQEKIHALTSENTNLKKMMSNQYVPVKTHEEVKMTLNDTLAKTNRELLDVKKKFEDINQEFVKIKDKNEILKRNLENTQNQIKAEYISLAEHEAKMSSLSQSMRKVQDSNAEILANYRKGQEEIVTLHAEIKAQKKELDTIQECIKVKYAPIVSFEECERKFKATEKELKDQLSEQTQKYSVSEEEVKKNKQENDKLKKEIFTLQKDLRDKTVLIEKSHEMERALSRKTDELNKQLKDLSQKYTEVKNVKEKLVEENAKQTSEILAVQNLLQKQHVPLEQVEALKKSLNGTIENLKEELKSMQRCYEKEQQTVTKLHQLLENQKNSSVPLAEHLQIKEAFEKEVGIIKASLREKEEESQNKMEEVSKLQSEVQNTKQALKKLETREVVDLSKYKATKSDLETQISSLNEKLANLNRKYEEVCEEVLHAKKKEISAKDEKELLHFSIEQEIKDQKERCDKSLTTITELQRRIQESAKQIEAKDNKITELLNDVERLKQALNGLSQLTYTSGNPTKRQSQLIDTLQHQVKSLEQQLADADRQHQEVIAIYRTHLLSAAQGHMDEDVQEALLQIIQMRQGLVC

SEQ ID NO: 69451 - protein, 1403 aa, Homo sapiens
MMNCWFSCTPKNRHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVDGRTPLVLATQMSRPTICQLLIDRGADVNSRDKQNRTALMLGCEYGCRDAVEVLIKNGADISLLDALGHDSSYYARIGDNLDILTLLKTASENTNKGRELWKKGPSLQQRNLTHMQDEVNVKSHQREHQNIQDLEIENEDLKERLRKIQQEQRILLDKVNGLQLQLNEEVMVADDLESEREKLKSLLAAKEKQHEESLRTIEALKNRFKYFESDHLGSGSHFSNRKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEENKRLQKELSMCEMEREKKGRKVTEMEGQAKELSAKLALSIPAEKFENMKSSLSNEVNEKAKKLVEMEREHEKSLSEIRQLKRELENVKAKLAQHVKPEEHEQVKSRLEQKSGELGKKITELTLKNQTLQKEIEKVYLDNKLLKEQAHNLTIEMKNHYVPLKVSEDMKKSHDAIIDDLNRKLLDVTQKYTEKKLEMEKLLLENDSLSKDVSRLETVFVPPEKHEKEIIALKSNIVELKKQLSELKKKCGEDQEKIHALTSENTNLKKMMSNQYVPVKTHEEVKMTLNDTLAKTNRELLDVKKKFEDINQEFVKIKDKNEILKRNLENTQNQIKAEYISLAEHEAKMSSLSQSMRKVQDSNAEILANYRKGQEEIVTLHAEIKAQKKELDTIQECIKVKYAPIVSFEECERKFKATEKELKDQLSEQTQKYSVSEEEVKKNKQENDKLKKEIFTLQKDLRDKTVLIEKSHEMERALSRKTDELNKQLKDLSQKYTEVKNVKEKLVEENAKQTSEILAVQNLLQKQHVPLEQVEALKKSLNGTIENLKEELKSMQRCYEKEQQTVTKLHQLLENQKNSSVPLAEHLQIKEAFEKEVGIIKASLREKEEESQNKMEEVSKLQSEVQNTKQALKKLETREVVDLSKYKATKSDLETQISSLNEKLANLNRKYEEVCEEVLHAKKKEISAKDEKELLHFSIEQEIKDQKERCDKSLTTITELQRRIQESAKQIEAKDNKITELLNDVERLKQALNGLSQLTYTSGNPTKRQSQLIDTLQHQVKSLEQQLADADRQHQEVIAIYRTHLLSAAQGHMDEDVQEALLQIIQMRQGLVC

SEQ ID NO: 69452 - protein, 561 aa, Homo sapiens
MMNCWFSCTPKNRHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVDGRTPLVLATQMSRPTICQLLIDRGADVNSRDKQNRTALMLGCEYGCRDAVEVLIKNGADISLLDALGHDSSYYARIGDNLDILTLLKTASENTNKGRELWKKGPSLQQRNLTHMQDEVNVKSHQREHQNIQDLEIENEDLKERLRKIQQEQRILLDKVNGLQLQLNEREKLKSLLAAKEKQHEESLRTIEALKNRFKYFESDHLGSGSHFSNRKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLI

SEQ ID NO: 69453 - protein, 1401 aa, Homo sapiens
MMNCWFSCTPKNRHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVDGRTPLVLATQMSRPTICQLLIDRGADVNSRDKQNRTALMLGCEYGCRDAVEVLIKNGADISLLDALGHDSSYYARIGDNLDILTLLKTASENTNKGRELWKKGPSLQQRNLTHMQDEVNVKSHQREHQNIQDLEIENEDLKERLRKIQQEQRILLDKVNGLQLQLNEEVMVADDLESEREKLKSLLAAKEKQHEESLRTIEALKNRFKYFESDHLGSGSHFRKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEENKRLQKELSMCEMEREKKGRKVTEMEGQAKELSAKLALSIPAEKFENMKSSLSNEVNEKAKKLVEMEREHEKSLSEIRQLKRELENVKAKLAQHVKPEEHEQVKSRLEQKSGELGKKITELTLKNQTLQKEIEKVYLDNKLLKEQAHNLTIEMKNHYVPLKVSEDMKKSHDAIIDDLNRKLLDVTQKYTEKKLEMEKLLLENDSLSKDVSRLETVFVPPEKHEKEIIALKSNIVELKKQLSELKKKCGEDQEKIHALTSENTNLKKMMSNQYVPVKTHEEVKMTLNDTLAKTNRELLDVKKKFEDINQEFVKIKDKNEILKRNLENTQNQIKAEYISLAEHEAKMSSLSQSMRKVQDSNAEILANYRKGQEEIVTLHAEIKAQKKELDTIQECIKVKYAPIVSFEECERKFKATEKELKDQLSEQTQKYSVSEEEVKKNKQENDKLKKEIFTLQKDLRDKTVLIEKSHEMERALSRKTDELNKQLKDLSQKYTEVKNVKEKLVEENAKQTSEILAVQNLLQKQHVPLEQVEALKKSLNGTIENLKEELKSMQRCYEKEQQTVTKLHQLLENQKNSSVPLAEHLQIKEAFEKEVGIIKASLREKEEESQNKMEEVSKLQSEVQNTKQALKKLETREVVDLSKYKATKSDLETQISSLNEKLANLNRKYEEVCEEVLHAKKKEISAKDEKELLHFSIEQEIKDQKERCDKSLTTITELQRRIQESAKQIEAKDNKITELLNDVERLKQALNGLSQLTYTSGNPTKRQSQLIDTLQHQVKSLEQQLADADRQHQEVIAIYRTHLLSAAQGHMDEDVQEALLQIIQMRQGLVC

SEQ ID NO: 69454 - protein, 1064 aa, Homo sapiens
MVLGTVLLPPNSYGRDQDTSLCCLCTEASESALPDLTDHFASCVEDGFEGDKTGGSSPEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 69455 - protein, 542 aa, Homo sapiens
MGQQVGRVGEAPGLQQPQPRGIRGSSAARPSGRRRDPAGRTTETGFNIFTQHEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEVLLHCANQTCITL

SEQ ID NO: 69456 - protein, 1146 aa, Homo sapiens
MVLGTVLLPPNSYGRDQDTSLCCLCTEASESALPDLTEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGNFSSVASLQHADGFSFTPAQQEANLVPPKCYGGSFAQRNLCNDDGGGGGGSGTAGGGWSGITGFFTPRLIKKTLGLRAGKPTASDDTSKPFPRSNSTSSMSSGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 69457 - protein, 1182 aa, Homo sapiens
MGQQVGRVGEAPGLQQPQPRGIRGSSAARPSGRRRDPAGRTTETGFNIFTQHDHFASCVEDGFEGDKTGGSSPEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGNFSSVASLQHADGFSFTPAQQEANLVPPKCYGGSFAQRNLCNDDGGGGGGSGTAGGGWSGITGFFTPRLIKKTLGLRAGKPTASDDTSKPFPRSNSTSSMSSGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 69458 - protein, 1043 aa, Homo sapiens
MVLGTVLLPPNSYGRDQDTSLCCLCTEASESALPDLTEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 69459 - protein, 1167 aa, Homo sapiens
MVLGTVLLPPNSYGRDQDTSLCCLCTEASESALPDLTDHFASCVEDGFEGDKTGGSSPEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGNFSSVASLQHADGFSFTPAQQEANLVPPKCYGGSFAQRNLCNDDGGGGGGSGTAGGGWSGITGFFTPRLIKKTLGLRAGKPTASDDTSKPFPRSNSTSSMSSGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 69460 - protein, 1161 aa, Homo sapiens
MGQQVGRVGEAPGLQQPQPRGIRGSSAARPSGRRRDPAGRTTETGFNIFTQHEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGNFSSVASLQHADGFSFTPAQQEANLVPPKCYGGSFAQRNLCNDDGGGGGGSGTAGGGWSGITGFFTPRLIKKTLGLRAGKPTASDDTSKPFPRSNSTSSMSSGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 69461 - protein, 1058 aa, Homo sapiens
MGQQVGRVGEAPGLQQPQPRGIRGSSAARPSGRRRDPAGRTTETGFNIFTQHEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 69462 - protein, 1079 aa, Homo sapiens
MGQQVGRVGEAPGLQQPQPRGIRGSSAARPSGRRRDPAGRTTETGFNIFTQHDHFASCVEDGFEGDKTGGSSPEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 69463 - protein, 782 aa, Homo sapiens
MNPEKDFAPLTPNIVRALNDKLYEKRKVAALEIEKLVREFVAQNNTVQIKHVIQTLSQEFALSQHPHSRKGGLIGLAACSIALGKDSGLYLKELIEPVLTCFNDADSRLRYYACEALYNIVKVARGAVLPHFNVLFDGLSKLAADPDPNVKSGSELLDRLLKDIVTESNKFDLVSFIPLLRERIYSNNQYARQFIISWILVLESVPDINLLDYLPEILDGLFQILGDNGKEIRKMCEVVLGEFLKEIKKNPSSVKFAEMANILVIHCQTTDDLIQLTAMCWMREFIQLAGRVMLPYSSGILTAVLPCLAYDDRKKSIKEVANVCNQSLMKLVTPEDDELDELRPGQRQAEPTPDDALPKQEGTASGGPDGSCDSSFSSGISVFTAASTERAPVTLHLDGIVQVLNCHLSDTAIGMMTRIAVLKWLYHLYIKTPRKMFRHTDSLFPILLQTLSDESDEVILKDLEVLAEIASSPAGQTDDPGPLDGPDLQASHSELQVPTPGRAGLLNTSGTKGLECSPSTPTMNSYFYKFMINLLKRFSSERKLLEVRGPFIIRQLCLLLNAENIFHSMADILLREEDLKFASTMVHALNTILLTSTELFQLRNQLKDLKTLESQNLFCCLYRSWCHNPVTTVSLCFLTQNYRHAYDLIQKFGDLEVTVDFLAEVDKLVQLIECPIFTYLRLQLLDVKNNPYLIKALYGLLMLLPQSSAFQLLSHRLQCVPNPELLQTEDSLKAAPKSQKADSPSIDYAELLQHFEKVQNKHLEVRHQRSGRGDHLDRRVVL

SEQ ID NO: 69464 - protein, 214 aa, Homo sapiens
MADILLREEDLKFASTMVHALNTILLTSTELFQLRNQLKDLKTLESQNLFCCLYRSWCHNPVTTVSLCFLTQNYRHAYDLIQKFGDLEVTVDFLAEVDKLVQLIECPIFTYLRLQLLDVKNNPYLIKALYGLLMLLPQSSAFQLLSHRLQCVPNPELLQTEDSLKAAPKSQKADSPSIDYAELLQHFEKVQNKHLEVRHQRSGRGDHLDRRVVL

SEQ ID NO: 69465 - protein, 396 aa, Homo sapiens
MPRVKAAQAGRQSSAKRHLAEQFAVGEIITDMAKKEWKVGLPIGQGGFGCIYLADMNSSESVGSDAPCVVKVEPSDNGPLFTELKFYQRAAKPEQIQKWIRTRKLKYLGVPKYWGSGLHDKNGKSYRFMIMDRFGSDLQKIYEANAKRFSRKTVLQLSLRILDILEYIHEHEYVHGDIKASNLLLNYKNPDQVYLVDYGLAYRYCPEGVHKEYKEDPKRCHDGTIEFTSIDAHNGVAPSRRGDLEILGYCMIQWLTGHLPWEDNLKDPKYVRDSKIRYRENIASLMDKCFPEKNKPGEIAKYMETVKLLDYTEKPLYENLRDILLQGLKAIGSKDDGKLDLSVVENGGLKAKTITKKRKKEIEESKEPGVEDTEWSNTQTEEAIQTRSRTRKRVQK

SEQ ID NO: 69466 - protein, 508 aa, Homo sapiens
MPPKRNEKYKLPIPFPEGKVLDDMEGNQWVLGKKIGSGGFGLIYLAFPTNKPEKDARHVVKVEYQENGPLFSELKFYQRVAKKDCIKKWIERKQLDYLGIPLFYGSGLTEFKGRSYRFMVMERLGIDLQKISGQNGTFKKSTVLQLGIRMLDVLEYIHENEYVHGDIKAANLLLGYKNPDQVYLADYGLSYRYCPNGNHKQYQENPRKGHNGTIEFTSLDAHKGVALSRRSDVEILGYCMLRWLCGKLPWEQNLKDPVAVQTAKTNLLDELPQSVLKWAPSGSSCCEIAQFLVCAHSLAYDEKPNYQALKKILNPHGIPLGPLDFSTKGQSINVHTPNSQKVDSQKAATKQVNKAHNRLIEKKVHSERSAESCATWKVQKEEKLIGLMNNEAAQESTRRRQKYQESQEPLNEVNSFPQKISYTQFPNSFYEPHQDFTSPDIFKKSRSPSWYKYTSTVSTGITDLESSTGLWPTISQFTLSEETNADVYYYRIIIPVLLMLVFLALFFL

SEQ ID NO: 69467 - protein, 400 aa, Homo sapiens
MPPKRNEKYKLPIPFPEGKVLDDMEGNQWVLGKKIGSGGFGLIYLAFPTNKPEKDARHVVKVEYQENGPLFSELKFYQRVAKKDCIKKWIERKQLDYLGIPLFYGSGLTEFKGRSYRFMVMERLGIDLQKISGQNGTFKKSTVLQLGIRMLDVLEYIHENEYVHGDIKAANLLLGYKNPDQVYLADYGLSYRYCPNGNHKQYQENPRKGHNGTIEFTSLDAHKGVALSRRSDVEILGYCMLRWLCGKLPWEQNLKDPVAVQTAKTNLLDELPQSVLKWAPSGSSCCEIAQFLVCAHSLAYDEKPNYQALKKILNPHGIPLGPLDFSTKGQSINVHTPNSQKVDSQKAATKQVNKAHNRLIEKKVHSERSAESCATWKVQKEEKLIGLMNNEAAQIRQLGY

SEQ ID NO: 69468 - protein, 396 aa, Homo sapiens
MPPKRNEKYKLPIPFPEGKVLDDMEGNQWVLGKKIGSGGFGLIYLAFPTNKPEKDARHVVKVEYQENGPLFSELKFYQRVAKKDCIKKWIERKQLDYLGIPLFYGSGLTEFKGRSYRFMVMERLGIDLQKISGQNGTFKKSTVLQLGIRMLDVLEYIHENEYVHGDIKAANLLLGYKNPDQVYLADYGLSYRYCPNGNHKQYQENPRKGHNGTIEFTSLDAHKGVALSRRSDVEILGYCMLRWLCGKLPWEQNLKDPVAVQTAKTNLLDELPQSVLKWAPSGSSCCEIAQFLVCAHSLAYDEKPNYQALKKILNPHGIPLGPLDFSTKGQSINVHTPNSQKVDSQKAATKQVNKAHNRLIEKKVHSERSAESCATWKVQKEEKLIGLMNNEAAQFR

SEQ ID NO: 69469 - protein, 291 aa, Homo sapiens [sequence omitted]

SEQ ID NO: 69470 - protein, 508 aa, Homo sapiens; identical to SEQ ID NO: 69466

SEQ ID NO: 69471 - protein, 485 aa, Homo sapiens
MEGNQWVLGKKIGSGGFGLIYLAFPTNKPEKDARHVVKVEYQENGPLFSELKFYQRVAKKDCIKKWIERKQLDYLGIPLFYGSGLTEFKGRSYRFMVMERLGIDLQKISGQNGTFKKSTVLQLGIRMLDVLEYIHENEYVHGDIKAANLLLGYKNPDQVYLADYGLSYRYCPNGNHKQYQENPRKGHNGTIEFTSLDAHKGVALSRRSDVEILGYCMLRWLCGKLPWEQNLKDPVAVQTAKTNLLDELPQSVLKWAPSGSSCCEIAQFLVCAHSLAYDEKPNYQALKKILNPHGIPLGPLDFSTKGQSINVHTPNSQKVDSQKAATKQVNKAHNRLIEKKVHSERSAESCATWKVQKEEKLIGLMNNEAAQESTRRRQKYQESQEPLNEVNSFPQKISYTQFPNSFYEPHQDFTSPDIFKKSRSPSWYKYTSTVSTGITDLESSTGLWPTISQFTLSEETNADVYYYRIIIPVLLMLVFLALFFL

SEQ ID NO: 69472 - protein, 176 aa, Homo sapiens
MAMSFEWPWQYRFPPFFTLQPNVDTRQKQLAAWCSLVLSFCRLHKQSSMTVMEAQESPLFNNVKLQRKLPVESIQIVLEELRKKGNLEWLDKSKSSFLIMWRRPEEWGKLIYQWVSRSGQNNSVFTLYELTNGEDTEDEEFHGLDEATLLRALQALQQEHKAEIITVSDGRGVKFF

SEQ ID NO: 69473 - protein, 327 aa, Homo sapiens
MSFLGGFFGPICEIDIVLNDGETRKMAEMKTEDGKVEKHYLFYDGESVSGKVNLAFKQPGKRLEHQGIRIEFVGQIELFNDKSNTHEFVNLVKELALPGELTQSRSYDFEFMQVEKPYESYIGANVRLRYFLKVTIVRRLTDLVKEYDLIVHQLATYPDVNNSIKMEVGIEDCLHIEFEYNKSKYHLKDVIVGKIYFLLVRIKIQHMELQLIKKEITGIGPSTTTETETIAKYEIMDGAPVKGESIPIRLFLAGYDPTPTMRDVNKKFSVRYFLNLVLVDEEDRRYFKQQEIILWRKAPEKLRKQRTNFHQRFESPESQASAEQPEM

SEQ ID NO: 69474 - protein, 327 aa, Homo sapiens; identical to SEQ ID NO: 69473

SEQ ID NO: 69475 - protein, 251 aa, Homo sapiens
MSFLGGFFGPICEIDIVLNDGETRKMAEMKTEDGKVEKHYLFYDGESVSGKVNLAFKQPGKRLEHQGIRIEFVGQIELFNDKSNTHEFVNLVKELALPGELTQSRSYDFEFMQVEKPYESYIGANVRLRYFLKVTIVRRLTDLVKEYDLIVHQLATYPDVNNSIKMEVGIEDCLHIEFEYNKSKYHLKDVIVGKIYFLLVRIKIQHMELQLIKKEITGIGPSTTTETETIAKYEIMDGAPVKGDNFMEKSS

SEQ ID NO: 69476 - protein, 216 aa, Homo sapiens
MQVEKPYESYIGANVRLRYFLKVTIVRRLTDLVKEYDLIVHQLATYPDVNNSIKMEVGIEDCLHIEFEYNKSKYHLKDVIVGKIYFLLVRIKIQHMELQLIKKEITGIGPSTTTETETIAKYEIMDGAPVKGESIPIRLFLAGYDPTPTMRDVNKKFSVRYFLNLVLVDEEDRRYFKQQEIILWRKAPEKLRKQRTNFHQRFESPESQASAEQPEM

SEQ ID NO: 69477 - protein, 310 aa, Homo sapiens
MTENPFQERYSVEDLSTFGMCLCMVRYVYDAFYKVNLAFKQPGKRLEHQGIRIEFVGQIELFNDKSNTHEFVNLVKELALPGELTQSRSYDFEFMQVEKPYESYIGANVRLRYFLKVTIVRRLTDLVKEYDLIVHQLATYPDVNNSIKMEVGIEDCLHIEFEYNKSKYHLKDVIVGKIYFLLVRIKIQHMELQLIKKEITGIGPSTTTETETIAKYEIMDGAPVKGESIPIRLFLAGYDPTPTMRDVNKKFSVRYFLNLVLVDEEDRRYFKQQEIILWRKAPEKLRKQRTNFHQRFESPESQASAEQPEM

SEQ ID NO: 69478 - protein, 336 aa, Homo sapiens
MSFFGFGQSVEVEILLNDAESRKRAEHKTEDGKKEKYFLFYDGETVSGKVSLALKNPNKRLEHQGIKIEFIGQIELYYDRGNHHEFVSLVKDLARPGEITQSQAFDFEFTHVEKPYESYTGQNVKLRYFLRATISRRLNDVVKEMDIVVHTLSTYPELNSSIKMEVGIEDCLHIEFEYNKSKYHLKDVIVGKIYFLLVRIKIKHMEIDIIKRETTGTGPNVYHENDTIAKYEIMDGAPVRGESIPIRLFLAGYELTPTMRDINKKFSVRYYLNLVLIDEEERRYFKQQEVVLWRKGDIVRKSMSHQAAIASQRFEGTTSLGEVRTPSQLSDNNCRQ

SEQ ID NO: 69479 - protein, 221 aa, Homo sapiens
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWLQTLSGMSASDELDDSQVRQMLFDLESAYNAFNRFLHA

SEQ ID NO: 69480 - protein, 233 aa, Homo sapiens
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWWVSLPARQSPAVPETLPARRSPAVPLRPSAPTCPVLHSQAADPERHVGVR

SEQ ID NO: 69481 - protein, 221 aa, Homo sapiens; identical to SEQ ID NO: 69479

SEQ ID NO: 69482 - protein, 596 aa, Homo sapiens
MAAHLSYGRVNLNVLREAVRRELREFLDKCAGSKAIVWDEYLTGPFGLIAQYSLLKEHEVEKMFTLKGNRLPAADVKNIIFFVRPRLELMDIIAENVLSEDRRGPTRDFHILFVPRRSLLCEQRLKDLGVLGSFIHREEYSLDLIPFDGDLLSMESEGAFKECYLEGDQTSLYHAAKGLMTLQALYGTIPQIFGKGECARQVANMMIRMKREFTGSQNSIFPVFDNLLLLDRNVDLLTPLATQLTYEGLIDEIYGIQNSYVKLPPEKFAPKKQGDGGKDLPTEAKKLQLNSAEELYAEIRDKNFNAVGSVLSKKAKIISAAFEERHNAKTVGEIKQFVSQLPHMQAARGSLANHTSIAELIKDVTTSEDFFDKLTVEQEFMSGIDTDKVNNYIEDCIAQKHSLIKVLRLVCLQSVCNSGLKQKVLDYYKREILQTYGYEHILTLHNLEKAGLLKPQTGGRNNYPTIRKTLRLWMDDVNEQNPTDISYVYSGYAPLSVRLAQLLSRPGWRSIEEVLRILPGPHFEERQPLPTGLQKKRQPGENRVTLIFFLGGVTFAEIAALRFLSQLEDGGTEYVIATTKLMNGTSWIEALMEKPF

SEQ ID NO: 69483 - protein, 617 aa, Homo sapiens
MAFPHRPDAPELPDFSMLKRLARDQLIYLLEQLPGKKDLFIEADLMSPLDRIANVSILKQHEVDKLYKVENKPALSSNEQLCFLVRPRIKNMRYIASLVNADKLAGRTRKYKVIFSPQKFYACEMVLEEEGIYGDVSCDEWAFSLLPLDVDLLSMELPEFFRDYFLEGDQRWINTVAQALHLLSTLYGPFPNCYGIGRCAKMAYELWRNLEEEEDGETKGRRPEIGHIFLLDRDVDFVTALCSQVVYEGLVDDTFRIKCGSVDFGPEVTSSDKSLKVLLNAEDKVFNEIRNEHFSNVFGFLSQKARNLQAQYDRRRGMDIKQMKNFVSQELKGLKQEHRLLSLHIGACESIMKKKTKQDFQELIKTEHALLEGFNIRESTSYIEEHIDRQVSPIESLRLMCLLSITENGLIPKDYRSLKTQYLQSYGPEHLLTFSNLRRAGLLTEQAPGDTLTAVESKVSKLVTDKAAGKITDAFSSLAKRSNFRAISKKLNLIPRVDGEYDLKVPRDMAYVFGGAYVPLSCRIIEQVLERRSWQGLDEVVRLLNCSDFAFTDMTKEDKASSESLRLILVVFLGGCTFSEISALRFLGREKGYRFIFLTTAVTNSARLMEAMSEVKA

SEQ ID NO: 69484 - protein, 572 aa, Homo sapiens [sequence omitted]

SEQ ID NO: 69485 - protein, 796 aa, Homo sapiens
MPTTQQSPQDEQEKLLDEAIQAVKVQSFQMKRCLDKNKLMDALKHASNMLGELRTSMLSPKSYYELYMAISDELHYLEVYLTDEFAKGRKVADLYELVQYAGNIIPRLYLLITVGVVYVKSFPQSRKDILKDLVEMCRGVQHPLRGLFLRNYLLQCTRNILPDEGEPTDEETTGDISDSMDFVLLNFAEMNKLWVRMQHQGHSRDREKRERERQELRILVGTNLVRLSQLEGVNVERYKQIVLTGILEQVVNCRDALAQEYLMECIIQVFPDEFHLQTLNPFLRACAELHQNVNVKNIIIALIDRLALFAHREDGPGIPADIKLFDIFSQQVATVIQSRQDMPSEDVVSLQVSLINLAMKCYPDRVDYVDKVLETTVEIFNKLNLEHIATSSAVSKELTRLLKIPVDTYNNILTVLKLKHFHPLFEYFDYESRKSMSCYVLSNVLDYNTEIVSQDQVDSIMNLVSTLIQDQPDQPVEDPDPEDFADEQSLVGRFIHLLRSEDPDQQYLILNTARKHFGAGGNQRIRFTLPPLVFAAYQLAFRYKENSKVDDKWEKKCQKIFSFAHQTISALIKAELAELPLRLFLQGALAAGEIGFENHETVAYEFMSQAFSLYEDEISDSKAQLAAITLIIGTFERMKCFSEENHEPLRTQCALAASKLLKKPDQGRAVSTCAHLFWSGRNTDKNGEELHGGKRVMECLKKALKIANQCMDPSLQVQLFIEILNRYIYFYEKENDAVTIQVLNQLIQKIREDLPNLESSEETEQINKHFHNTLEHLRLRRESPESEGPIYEGLIL

SEQ ID NO: 69486 - protein, 662 aa, Homo sapiens
MCRGVQHPLRGLFLRNYLLQCTRNILPDEGEPTDEETTGDISDSMDFVLLNFAEMNKLWVRMQHQGHSRDREKRERERQELRILVGTNLVRLSQLEGVNVERYKQIVLTGILEQVVNCRDALAQEYLMECIIQVFPDEFHLQTLNPFLRACAELHQNVNVKNIIIALIDRLALFAHREDGPGIPADIKLFDIFSQQVATVIQSRQDMPSEDVVSLQVSLINLAMKCYPDRVDYVDKVLETTVEIFNKLNLEHIATSSAVSKELTRLLKIPVDTYNNILTVLKLKHFHPLFEYFDYESRKSMSCYVLSNVLDYNTEIVSQDQVDSIMNLVSTLIQDQPDQPVEDPDPEDFADEQSLVGRFIHLLRSEDPDQQYLILNTARKHFGAGGNQRIRFTLPPLVFAAYQLAFRYKENSKVDDKWEKKCQKIFSFAHQTISALIKAELAELPLRLFLQGALAAGEIGFENHETVAYEFMSQAFSLYEDEISDSKAQLAAITLIIGTFERMKCFSEENHEPLRTQCALAASKLLKKPDQGRAVSTCAHLFWSGRNTDKNGEELHGGKRVMECLKKALKIANQCMDPSLQVQLFIEILNRYIYFYEKENDAIVTIQVLNQLIQKIREDLPNLESSEETEQINKHFHNTLEHLRLRRESPESEGPIYEGLIL

SEQ ID NO: 69487 - protein, 386 aa, Homo sapiens
MDRFVWTSGLLEINETLVIQQRGVRIYDGEEKIKFDAGTLLLSTHRLIWRDQKNHECCMAILLSQIVFIEEQAAGIGKSAKIVVHLHPAPPNKEPGPFQSSKNSYIKLSFKEHGQIEFYRRLSEEMTQRRWENMPVSQSLQTNRGPQPGRIRAVGIVGIERKLEEKRKETDKNISEAFEDLSKLMIKAKEMVELSKSIANKIKDKQGDITEDETIRFKSYLLSMGIANPVTRETYGSGTQYHMQLAKQLAGILQVPLEERGGIMSLTEVYCLVNRARGMELLSPEDLVNACKMLEALKLPLRLRVFDSGVMVIELQSHKEEEMVASALETVSEKGSLTSEEFAKLVGMSVLLAKERLLLAEKMGHLCRDDSVEGLRFYPNLFMTQS

SEQ ID NO: 69488 - protein, 185 aa, Homo sapiens
MSWLFPLTKSASSSAAGSPGGLTSLQQQKQRLIESLRNSHSSIAEIQKDVEYRLPFTINNLTININILLPPQFPQEKPVISVYPPIRHHLMDKQGVYVTSPLVNNFTMHSDLGKIIQSLLDEFWKNPPVLAPTSTAFPYQLEIRWHHPHCLEISLARSSNSLGFSISSSISSTRSKQEYHFFICC

SEQ ID NO: 69489 - protein, 397 aa, Homo sapiens
MSWLFPLTKSASSSAAGSPGGLTSLQQQKQRLIESLRNSHSSIAEIQKDVEYRLPFTINNLTININILLPPQFPQEKPVISVYPPIRHHLMDKQGVYVTSPLVNNFTMHSDLGKIIQSLLDEFWKNPPVLAPTSTAFPYLYSNPSGMSPYASQGFPFLPPYPPQEANRSITSLSVADTVSSSTTSHTTAKPAAPSFGVLSNLPLPIPTVDASIPTSQNGFGYKMPDVPDAFPELSELSVSQLTDMNEQEEVLLEQFLTLPQLKQIITDKDDLVKSIEELARKNLLLEPSLEAKRQTVLDKYELLTQMKSTFEKKMQRQHELSESCSASALQARLKVAAHEAEEESDNIAEDFLEGKMEIDDFLSSFMEKRTICHCRRAKEEKLQQAIAMHSQFHAPL

SEQ ID NO: 69490 - protein, 372 aa, Homo sapiens
MSWLFPLTKSASSSAAGSPGGLTSLQQQKQRLIESLRNSHSRLLPPQFPQEKPVISVYPPIRHHLMDKQGVYVTSPLVNNFTMHSDLGKIIQSLLDEFWKNPPVLAPTSTAFPYLYSNPSGMSPYASQGFPFLPPYPPQEANRSITSLSVADTVSSSTTSHTTAKPAAPSFGVLSNLPLPIPTVDASIPTSQNGFGYKMPDVPDAFPELSELSVSQLTDMNEQEEVLLEQFLTLPQLKQIITDKDDLVKSIEELARKNLLLEPSLEAKRQTVLDKYELLTQMKSTFEKKMQRQHELSESCSASALQARLKVAAHEAEEESDNIAEDFLEGKMEIDDFLSSFMEKRTICHCRRAKEEKLQQAIAMHSQFHAPL

SEQ ID NO: 69491 - protein, 285 aa, Homo sapiens
MAGAGSEARFAGLSLVQLNELLEDEGQLTEMVQKMEETQNVQLNKEMTLASNRSLAEGNLLYQPQLDTLKARLTQKYQELQVLFEAYQIKKTKLDRQSSSASLETLLALLQAEGAKIEEDTENMAEKFLDGELPLDSFIDVYQSKRKLAHMRRVKIEKLQEMVLKGQRLPQALAPLPPRLPELAPTAPLPYPAPEASGPPAVAPRRIPPPPPPVPAGRLATPFTAAMSSGQAVPYPGLQCPPLPPRVGLPTQQGFSSQFVSPYPPPLPQRPPPRLPPHQPGFILQ

SEQ ID NO: 69492 - protein, 355 aa, Homo sapiens
METLKDKTLQELEELQNDSEAIDQLALESPEVQDLQLEREMALATNRSLAERNLEFQGPLEISRSNLSDRYQELRKLVERCQEQKAKLEKFSSALQPGTLLDLLQVEGMKIEEESEAMAEKFLEGEVPLETFLENFSSMRMLSHLRRVRVEKLQEVVRKPRASQELAGDAPPPRPPPPVRPVPQGTPPVVEEQPQPPLAMPPYPLPYSPSPSLPVGPTAHGALPPAPFPVVSQPSFYSGPLGPTYPAAQLGPRGAAGYSWSPQRSMPPRPGYPGTPMGASGPGYPLRGGRAPSPGYPQQSPYPATGGKPPYPIQPQLPSFPGQPQPSVPLQPPYPPGPAPPYGFPPPPGPAWPGY

SEQ ID NO: 69493 - protein, 148 aa, Homo sapiens
METLKDKTLQELEELQNDSEAIDQLALESPEVQDLQLEREMALATNRSLAERNLEFQGPLEISRSNLSDRYQELRKLVERCQEQKAKLEKFSSALQPGTLLDLLQVEGMKIEEESEAMAEKFLEGEVPLETFLENFSSMRMLSHLRRV

SEQ ID NO: 69494 - protein, 322 aa, Homo sapiens
METLKDKTLQELEELQNDSEAIDQLALESPEVQDLQLEREMALATNRSLAERNLEFQGPLEISRSNLSDRYQELRKLVERCQEQKAKLEKFSSALQPGTLLDLLQVEGMKIEEESEAMAEKFLEGEVPLETFLENFSSMRMLSHLRRVRVEKLQEVVRKPRASQELAGDAPPPRPPPPVRPVPQGTPPVVEEQPQPPLAMPPYPLPYSPSPSLPVGPTAHGALPPAPFPVVSQPSFYSGPLGPTYPAAQLGPRGAAGYSWSPQRSMPPRPGYPGTPMGASGPGYPLRGGRAPSPGYPQQSPYPATGGKPPYPIQPQLPFSLC

SEQ ID NO: 69495 - protein, 251 aa, Homo sapiens
MYRARAARAGPEPGSPGRFGILSTGQLRDLLQDEPKLDRIVRLSRKFQGLQLEREACLASNYALAKENLALRPRLEMGRAALAIKYQELREVAENCADKLQRLEESMHRWSPHCALGWLQAELEEAEQEAEEQMEQLLLGEQSLEAFLPAFQRGRALAHLRRTQAEKLQELLRRRERSAQPAPTSAADPPKSFPAAAVLPTGAARGPPAVPRSLPPLDSRPVPPLKGSPGCPLGPAPLLSPRPSQPEPPHR

SEQ ID NO: 69496 - protein, 875 aa, Homo sapiens
MHDAFEPVPILEKLPLQIDCLAAWEEWLLVGTKQGHLLLYRIRKDVGCNRFEVTLEKSNKNFSKKIQQIHVVSQFKILVSLLENNIYVHDLLTFQQITTVSKAKGASLFTCDLQHTETGEEVLRMCVAVKKKLQLYFWKDREFHELQGDFSVPDVPKSMAWCENSICVGFKRDYYLIRVDGKGSIKELFPTGKQLEPLVAPLADGKVAVGQDDLTVVLNEEGICTQKCALNWTDIPVAMEHQPPYIIAVLPRYVEIRTFEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTDPTHVMGLYPDLLPTDYRKQLQYPNPLPVLSGAELEKAHLALIDYLTQKRSQLVKKLNDSDHQSSTSPLMEGTPTIKSKKKLLQIIDTTLLKCYLHTNVALVAPLLRLENNHCHIEESEHVLKKAHKYSELIILYEKKGLHEKALQVLVDQSKKANSPLKGHERTVQYLQHLGTENLHLIFSYSVWVLRDFPEDGLKIFTEDLPEVESLPRDRVLGFLIENFKGLAIPYLEHIIHVWEETGSRFHNCLIQLYCEKVQGLMKEYLLSFPAGKTPVPAGEEEGELGEYRQKLLMFLEISSYYDPGRLICDFPFDGLLEERALLLGRMGKHEQALFIYVHILKDTRMAEEYCHKHYDRNKDGNKDVYLSLLRMYLSPPSIHCLGPIKLELLEPKANLQAALQVLELHHSKLDTTKALNLLPANTQINDIRIFLEKVLEENAQKKRFNQVLKNLLHAEFLRVQEERILHQQVKCIITEEKVCMVCKKKIGNSAFARYPNGVVVHYFCSKEVNPADT

SEQ ID NO: 69497 - protein, 886 aa, Homo sapiens
MHDAFEPVPILEKLPLQIDCLAAWEEWLLVGTKQGHLLLYRIRKDVVPADVASPESGSCNRFEVTLEKSNKNFSKKIQQIHVVSQFKILVSLLENNIYVHDLLTFQQITTVSKAKGASLFTCDLQHTETGEEVLRMCVAVKKKLQLYFWKDREFHELQGDFSVPDVPKSMAWCENSICVGFKRDYYLIRVDGKGSIKELFPTGKQLEPLVAPLADGKVAVGQDDLTVVLNEEGICTQKCALNWTDIPVAMEHQPPYIIAVLPRYVEIRTFEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTDPTHVMGLYPDLLPTDYRKQLQYPNPLPVLSGAELEKAHLALIDYLTQKRSQLVKKLNDSDHQSSTSPLMEGTPTIKSKKKLLQIIDTTLLKCYLHTNVALVAPLLRLENNHCHIEESEHVLKKAHKYSELIILYEKKGLHEKALQVLVDQSKKANSPLKGHERTVQYLQHLGTENLHLIFSYSVWVLRDFPEDGLKIFTEDLPEVESLPRDRVLGFLIENFKGLAIPYLEHIIHVWEETGSRFHNCLIQLYCEKVQGLMKEYLLSFPAGKTPVPAGEEEGELGEYRQKLLMFLEISSYYDPGRLICDFPFDGLLEERALLLGRMGKHEQALFIYVHILKDTRMAEEYCHKHYDRNKDGNKDVYLSLLRMYLSPPSIHCLGPIKLELLEPKANLQAALQVLELHHSKLDTTKALNLLPANTQINDIRIFLEKVLEENAQKKRFNQVLKNLLHAEFLRVQEERILHQQVKCIITEEKVCMVCKKKIGNSAFARYPNGVVVHYFCSKEVNPADT

SEQ ID NO: 69498 - protein, 437 aa, Homo sapiens
MTTSTLQKAIDLVTKATEEDKAKNYEEALRLYQHAVEYFLHAIKYEAHSDKAKESIRAKCVQYLDRAEKLKDYLRSKEKHGKKPVKENQSEGKGSDSDSEGDNPEKKKLQEQLMGAVVMEKPNIRWNDVAGLEGAKEALKEAVILPIKFPHLFTGKRTPWRGILLFGPPGTGKSYLAKAVATEANNSTFFSVSSSDLMSKWLGESEKLVKNLFELARQHKPSIIFIDEVDSLCGSRNENESEAARRIKTEFLVQMQGVGNNNDGTLVLGATNIPWVLDSAIRRRFEKRIYIPLPEEAARAQMFRLHLGSTPHNLTDANIHELARKTEGYSGADISIIVRDSLMQPVRKVQSATHFKKVCGPSRTNPSMMIDDLLTPCSPGDPGAMEMTWMDVPGDKLLEPVVCMSDMLRSLATTRPTVNADDLLKVKKFSEDFGQES

SEQ ID NO: 69499 - protein, 444 aa, Homo sapiens
MSSTSPNLQKAIDLASKAAQEDKAGNYEEALQLYQHAVQYFLHVVKYEAQGDKAKQSIRAKCTEYLDRAEKLKEYLKNKEKKAQKPVKEGQPSPADEKGNDSDGEGESDDPEKKKLQNQLQGAIVIERPNVKWSDVAGLEGAKEALKEAVILPIKFPHLFTGKRTPWRGILLFGPPGTGKSYLAKAVATEANNSTFFSISSSDLVSKWLGESEKLVKNLFQLARENKPSIIFIDEIDSLCGSRSENESEAARRIKTEFLVQMQGVGVDNDGILVLGATNIPWVLDSAIRRRFEKRIYIPLPEPHARAAMFKLHLGTTQNSLTEADFRELGRKTDGYSGADISIIVRDALMQPVRKVQSATHFKKVRGPSRADPNHLVDDLLTPCSPGDPGAIEMTWMDVPGDKLLEPVVSMSDMLRSLSNTKPTVNEHDLLKLKKFTEDFGQEG

SEQ ID NO: 69500 - protein, 209 aa, Homo sapiens
MAEAEEQETGSLEESTDESEEEESEEEPKLKYERLSNGVTEILQKDAASCMTVHDKFLALGTHYGKVYLLDVQGNITQKFDVSPVKINQISLDESGEHMGVCSEDGKVQVFGLYSGEEFHETFDCPIKIIAVHPHFVRSSCKQFVTGGKKLLLFERSWMNRWKSAVLHEGEGNIRSVKWRGHLIAWANNMSKKPEAWRVAKKMKSYLNN

SEQ ID NO: 69501 - protein, 854 aa, Homo sapiens
MAEAEEQETGSLEESTDESEEEESEEEPKLKYERLSNGVTEILQKDAASCMTVHDKFLALGTHYGKVYLLDVQGNITQKFDVSPVKINQISLDESGEHMGVCSEDGKVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTLIIGWGTSVKVCSVKERHASEMRDLPSRYVEIVSQFETEFYISGLAPLCDQLVVLSYVKEISEKTEREYCARPRLDIIQPLSETCEEISSDALTVRGFQENECRDYHLEYSEGESLFYIVSPRDVVVAKERDQDDHIDWLLEKKKYEEALMAAEISQKNIKRHKILDIGLAYINHLVERGDYDIAARKCQKILGKNAALWEYEVYKFKEIGQLKAISPYLPRGDPVLKPLIYEMILHEFLESDYEGFATLIREWPGDLYNNSVIVQAVRDHLKKDSQNKTLLKTLAELYTYDKNYGNALEIYLTLRHKDVFQLIHKHNLFSSIKDKIVLLMDFDSEKAVDMLLDNEDKISIKKVVEELEDRPELQHVYLHKLFKRDHHKGQRYHEKQISLYAEYDRPNLLPFLRDSTHCPLEKALEICQQRNFVEETVYLLSRMGNSRSALKMIMEELHDVDKAIEFAKEQDDGELWEDLILYSIDKPPFITGLLNNIGTHVDPILLIHRIKEGMEIPNLRDSLVKILQDYNLQILLREGCKKILVADSLSLLKKMHRTQMKGVLVDEENICESCLSPILPSDAAKPFSVVVFHCRHMFHKECLPMPSMNSAAQFCNICSAKNRGPGSAILEMKK

SEQ ID NO: 69502 - protein, 829 aa, Homo sapiens
MAEAEEQETGSLEESTDESEEEESEEEPKLKYERLSNGVTEILQKDAASCMTVHDKFLALGTHYGKVYLLDVQGNITQKFDVVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTLIIGWGTSVKVCSVKERHASEMRDLPSRYVEIVSQFETEFYISGLAPLCDQLVVLSYVKEISEKTEREYCARPRLDIIQPLSETCEEISSDALTVRGFQENECRDYHLEYSEGESLFYIVSPRDVVVAKERDQDDHIDWLLEKKKYEEALMAAEISQKNIKRHKILDIGLAYINHLVERGDYDIAARKCQKILGKNAALWEYEVYKFKEIGQLKAISPYLPRGDPVLKPLIYEMILHEFLESDYEGFATLIREWPGDLYNNSVIVQAVRDHLKKDSQNKTLLKTLAELYTYDKNYGNALEIYLTLRHKDVFQLIHKHNLFSSIKDKIVLLMDFDSEKAVDMLLDNEDKISIKKVVEELEDRPELQHVYLHKLFKRDHHKGQRYHEKQISLYAEYDRPNLLPFLRDSTHCPLEKALEICQQRNFVEETVYLLSRMGNSRSALKMIMEELHDVDKAIEFAKEQDDGELWEDLILYSIDKPPFITGLLNNIGTHVDPILLIHRIKEGMEIPNLRDSLVKILQDYNLQILLREGCKKILVADSLSLLKKMHRTQMKGVLVDEENICESCLSPILPSDAAKPFSVVVFHCRHMFHKECLPMPSMNSAAQFCNICSAKNRGPGSAILEMKK

SEQ ID NO: 69503 - protein, 538 aa, Homo sapiens
MVYTQSEILQKEVYLFERIDSQNREIMKHLKAICFLRPTKENVDYIIQELRRPKYTIYFIYFSNVISKSDVKSLAEADEQEVVAEVQQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAARLVMLYALHYERHSSNSLPGLMMDLRNKGVSEKYRKLVSAVVEYGGKRVRGSDLFSPKDAVAITKQFLKGLKGVENVYTQHQPFLHETLDHLIKGRLKENLYPYLGPSTLRDRPQDIIVFVIGGATYEEALTVYNLNRTTPGVRIVLGGTTVHNTKRDGVSLCSPAWFRTPGLKRSTRLSLPKCWDYSFPRGSSGFWTAQPKQGELSSHIKVSEQKMKRWLGEGHSFLSCPHYRFSLLNKGVGEQLWVLCWLLELISR

SEQ ID NO: 69504 - protein, 570 aa, Homo sapiens
MNVVFAVKQYISKMIEDSGPGMKVLLMDKETTGIVSMVYTQSEILQKEVYLFERIDSQNREIMKHLKAICFLRPTKENVDYIIQELRRPKYTIYFIYFSNVISKSDVKSLAEADEQEVVAEVQEFYGDYIAVNPHLFSLNILGCCQGRNWDPAQLSRTTQGLTALLLSLKKCPMIRYQLSSEAAKRLAECVKQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAARLVMLYALHYERHSSNSLPGLMMDLRNKGVSEKYRKLVSAVVEYGGKRVRGSDLFSPKDAVAITKQFLKGLKGVENVYTQHQPFLHETLDHLIKGRLKENLYPYLGPSTLRDRPQDIIVFVIGGATYEEALTVYNLNRTTPGVRIVLGGTTVHNTKSFLEEVLASGLHSRSKESSQVTSRSASRR

SEQ ID NO: 69505 - protein, 316 aa, Homo sapiens
MNVVFAVKQYISKMIEDSGPGMKVLLMDKETTGIVSMVYTQSEILQKEVYLFERIDSQNREIMKHLKAICFLRPTKENVDYIIQELRRPKYTIYFIYFSNVISKSDVKSLAEADEQEVVAEVQQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAA

SEQ ID NO: 69506 - protein, 434 aa, Homo sapiens
MNVVFAVKQYISKMIEDSGPGMKVLLMDKETTGIVSMVYTQSEILQKEVYLFERIDSQNREIMKHLKAICFLRPTKENVDYIIQELRRPKYTIYFIYFSNVISKSDVKSLAEADEQEVVAEVQQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAARLVMLYALHYERHSSNSLPGLMMDLRNKGVSEKYRKLVSAVVEYGGKRVRGSDLFSPKDAVAITKQFLKGLKGVENVYTQHQPFLHETLDHLIKGRLKENLYPYLGPSTLRDRIASCL

SEQ ID NO: 69507 - protein, 445 aa, Homo sapiens [sequence omitted]

SEQ ID NO: 69508 - protein, 375 aa, Homo sapiens
MSLAGGRAPRKTAGNRLSGLLEAEEEDEFYQTTYGGFTEESGDDEYQGDQSDTEDEVDSDFDIDEGDEPSSDGEAEEPRRKRRVVTKAYKEPLKSLRPRKVNTPAGSSQKAREEKALLPLELQDDGSDSRKSMRQSTAEHTRQTFLRVQERQGQSRRRKGPHCERPLTQEELLREAKITEELNLRSLETYERLEADKKKQVHKKRKCPGPIITYHSVTVPLVGEPGPKEENVDIEGSLCFSLSFVLRLDPAPSVSALTPHAGTGPVNPPARCSRTFITFSDDATFEEWFPQGRPPKVPVREVCPVTHRPALYRDPVTDIPYATARAFKIIREAYKKYITAHGLPPTASALGPGPPPPEPLPGSGPRALRQKIVIK

SEQ ID NO: 69509 - protein, 364 aa, Homo sapiens
MSLAGGRAPRKTAGNRLSGLLEAEEEDEFYQTTYGGFTEESGDDEYQGDQSDTEDEVDSDFDIDEGDEPSSDGEAEEPRRKRRVVTKAYKEPLKSLRPRKVNTPAGSSQKAREEKALLPLELQDDGSDSRKSMRQSTAEHTRQTFLRVQERQGQSRRRKGPHCERPLTQEELLREAKITEELNLRSLETYERLEADKKKQVHKKRKCPGPIITYHSVTVPLVGEPGPKEENVDIEGLDPAPSVSALTPHAGTGPVNPPARCSRTFITFSDDATFEEWFPQGRPPKVPVREVCPVTHRPALYRDPVTDIPYATARAFKIIREAYKKYITAHGLPPTASALGPGPPPPEPLPGSGPRALRQKIVIK

SEQ ID NO: 69510 - protein, 406 aa, Homo sapiens
MAENGKNCDQRRVAMNKEHHNGNFTDPSSVNEKKRREREERQNIVLWRQPLITLQYFSLEILVILKEWTSKLWHRQSIVVSFLLLLAVLIATYYVEGVHQQYVQRIEKQFLLYAYWIGLGILSSVGLGTGLHTFLLYLGPHIASVTLAAYECNSVNFPEPPYPDQIICPDEEGTEGTISLWSIISKVRIEACMWGIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGAVPGIGPSLQKPFQEYLEAQRQKLHHKSEMGTPQGENWLSWMFEKLVVVMVCYFILSIINSMAQSYAKRIQQRLNSEEKTK

SEQ ID NO: 69511 - protein, 309 aa, Homo sapiens
MDLKYVQRIEKQFLLYAYWIGLGILSSVGLGTGLHTFLLYLGPHIASVTLAAYECNSVNFPEPPYPDQIICPDEEGTEGTISLWSIISKVRIEACMWGIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGAVPGIGPSLQKPFQEYLEAQRQKLHHKSEMGTPQGENWLSWMFEKLVVVMVCYFILSIINSMAQSYAKRIQQRLNSEEKTK

SEQ ID NO: 69512 - protein, 272 aa, Homo sapiens
MDLKGPHIASVTLAAYECNSVNFPEPPYPDQIICPDEEGTEGTISLWSIISKVRIEACMWGIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGAVPGIGPSLQKPFQEYLEAQRQKLHHKSEMGTPQGENWLSWMFEKLVVVMVCYFILSIINSMAQSYAKRIQQRLNSEEKTK

SEQ ID NO: 69513 - protein, 214 aa, Homo sapiens
MWGIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGAVPGIGPSLQKPFQEYLEAQRQKLHHKSEMGTPQGENWLSWMFEKLVVVMVCYFILSIINSMAQSYAKRIQQRLNSEEKTK

SEQ ID NO: 69514 - protein, 350 aa, Homo sapiens
MAENGKNCDQRRVAMNKEHHNGNFTDPSSVNEKKRREREERQNIVLWRQPLITLQYFSLEILVILKEWTSKLWHRQSIVVSFLLLLAVLIATYYVEGVHQQYVQRIEKQFLLYAYWIGLGILSSVGLGTGLHTFLLYLGIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGAVPGIGPSLQKPFQEYLEAQRQKLHHKSEMGTPQGENWLSWMFEKLVVVMVCYFILSIINSMAQSYAKRIQQRLNSEEKTK

SEQ ID NO: 69515 - protein, 480 aa, Homo sapiens [sequence omitted]

SEQ ID NO: 69516 - protein, 480 aa, Homo sapiens [sequence omitted]

SEQ ID NO: 69517 - protein, 418 aa, Homo sapiens
MKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASGTA

SEQ ID NO: 69518 - protein, 480 aa, Homo sapiens [sequence omitted]

SEQ ID NO: 69519 - protein, 480 aa, Homo sapiens [sequence omitted]

SEQ ID NO: 69520 - protein, 480 aa, Homo sapiens [sequence omitted]

SEQ ID NO: 69521 - protein, 92 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVET

SEQ ID NO: 69522 - protein, 806 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGNQGGAGPSQGSGGGTGGSVYTEDNDDDLYG

SEQ ID NO: 69523 - protein, 1222 aa, Homo sapiens
MSQPPPPPPPLPPPPPPPEAPQTPSSLASAAASGGLLKRRDRRILSGSCPDPKCQARLFFPASGSVSIECTECGQRHEQQQLLGVEEVTDPDVVLHNLLRNALLGVTGAPKKNTELVKVMGLSNYHCKLLSPILARYGMDKQTGRAKLLRDMNQGELFDCALLGDRAFLIEPEHVNTVGYGKDRSGSLLYLHDTLEDIKRANKSQECLIPVHVDGDGHCLVHAVSRALVGRELFWHALRENLKQHFQQHLARYQALFHDFIDAAEWEDIINECDPLFVPPEGVPLGLRNIHIFGLANVLHRPIILLDSLSGMRSSGDYSATFLPGLIPAEKCTGKDGHLNKPICIAWSSSGRNHYIPLVGIKGAALPKLPMNLLPKAWGVPQDLIKKYIKLEEDGGCVIGGDRSLQDKYLLRLVAAMEEVFMDKHGIHPSLVADVHQYFYRRTGVIGVQPEEVTAAAKKAVMDNRLHKCLLCGALSELHVPPEWLAPGGKLYNLAKSTHGQLRTDKNYSFPLNNLVCSYDSVKDVLVPDYGMSNLTACNWCHGTSVRKVRGDGSIVYLDGDRTNSRSTGGKCGCGFKHFWDGKEYDNLPEAFPITLEWGGRVVRETVYWFQYESDSSLNSNVYDVAMKLVTKHFPGEFGSEILVQKVVHTILHQTAKKNPDDYTPVNIDGAHAQRVGDVQGQESESQLPTKIILTGQKTKTLHKEELNMSKTERTIQQNITEQASVMQKRKTEKLKQEQKGQPRTVSPSTIRDGPSSAPATPTKAPYSPTTSKEKKIRITTNDGRQSMVTLKSSTTFFELQESIAREFNIPPYLQCIRYGFPPKELMPPQAGMEKEPVPLQHGDRITIEILKSKAEGGQSAAAHSAHTVKQEDIAVTGKLSSKELQEQAEKEMYSLCLLATLMGEDVWSYAKGLPHMFQQGGVFYSIMKKTMGMADGKHCTFPHLPGKTFVYNASEDRLELCVDAAGHFPIGPDVEDLVKEAVSQVRAEATTRSRESSPSHGLLKLGSGGVVKKKSEQLHNVTAFQGKGHSLGTASGNPHLDPRARETSVVRKHNTGTDFSNSSTKTEPSVFTASSSNSELIRIAPGVVTMRDGRQLDPDLVEAQRKKLQEMVSSIQASMDRHLRDQSTEQSPSDLPQRKTEVVSSSAKSGSLQTGLPESFPLTGGTENLNTETTDGCVADALGAAFATRSKAQRGNSVEELEEMDSQDAEMTNTTEPMDHS

SEQ ID NO: 69524 - protein, 1264 aa, Homo sapiens
MSTLYVSPHPDAFPSLRALIAARYGEAGEGPGWGGAHPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 69525 - protein, 1264 aa, Homo sapiens; identical to SEQ ID NO: 69524

SEQ ID NO: 69526 - protein, 174 aa, Homo sapiens
MSTLYVSPHPDAFPSLRALIAARYGEAGEGPGWGGAHPRICLQPPPTSRTSFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRY

SEQ ID NO: 69527 - protein, 174 aa, Homo sapiens; identical to SEQ ID NO: 69526

SEQ ID NO: 69528 - protein, 288 aa, Homo sapiens
  MOD_RES (1)..(1): Any amino acid
XKERGLFRGIEDNPMVVPLCNRSKDVVEPLLRPQWEWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVP

SEQ ID NO: 69529 - protein, 1264 aa, Homo sapiens [sequence omitted]

SEQ ID NO: 69530 - protein, 366 aa, Homo sapiens
MSTLYVSPHPDAFPSLRALIAARYGEAGEGPGWGGAHPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTR

SEQ ID NO: 69531 - protein, 174 aa, Homo sapiens
MSTLYVSPHPDAFPSLRALIAARYGEAGEGPGWGGAHPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRY

SEQ ID NO: 69532 - protein, 1183 aa, Homo sapiens
  MOD_RES (1)..(1): Any amino acid
XGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 69533 - protein, 174 aa, Homo sapiens; identical to SEQ ID NO: 69531

SEQ ID NO: 69534 - protein, 288 aa, Homo sapiens; identical to SEQ ID NO: 69528
  MOD_RES (1)..(1): Any amino acid

SEQ ID NO: 69535 - protein, 174 aa, Homo sapiens; identical to SEQ ID NO: 69531

SEQ ID NO: 69536 - protein, 288 aa, Homo sapiens; identical to SEQ ID NO: 69528
  MOD_RES (1)..(1): Any amino acid

SEQ ID NO: 69537 - protein, 288 aa, Homo sapiens; identical to SEQ ID NO: 69528
  MOD_RES (1)..(1): Any amino acid

SEQ ID NO: 69538 - protein, 1264 aa, Homo sapiens [sequence omitted]

SEQ ID NO: 69539 - protein, 174 aa, Homo sapiens; identical to SEQ ID NO: 69531

SEQ ID NO: 69540 - protein, 297 aa, Homo sapiens
MPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGPAQV

SEQ ID NO: 69541 - protein, 288 aa, Homo sapiens; identical to SEQ ID NO: 69528
  MOD_RES (1)..(1): Any amino acid

SEQ ID NO: 69542 - protein, 288 aa, Homo sapiens; identical to SEQ ID NO: 69528
  MOD_RES (1)..(1): Any amino acid

SEQ ID NO: 69543 - protein, 95 aa, Homo sapiens
  MOD_RES (1)..(1): Any amino acid
XPAGLGGPGGSRAAVLVQQWVSYADTELIPAACGATLPALGLRSSAQDPQAVLGALGRALSPLEEWLRLHTYLAGEAPTLADLAAVTALLLPFRY

SEQ ID NO: 69544 - protein, 1264 aa, Homo sapiens; identical to SEQ ID NO: 69524

SEQ ID NO: 69545 - protein, 676 aa, Homo sapiens
MSTLYVSPHPDAFPSLRALIAARYGEAGEGPGWGGAHPRICRLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 69546 - protein, 676 aa, Homo sapiens; identical to SEQ ID NO: 69545

SEQ ID NO: 69547 - protein, 297 aa, Homo sapiens; identical to SEQ ID NO: 69540

SEQ ID NO: 69548 - protein, 297 aa, Homo sapiens; identical to SEQ ID NO: 69540

SEQ ID NO: 69549 - protein, 297 aa, Homo sapiens; identical to SEQ ID NO: 69540

SEQ ID NO: 69550 - protein, 676 aa, Homo sapiens; identical to SEQ ID NO: 69545

SEQ ID NO: 69551 - protein, 676 aa, Homo sapiens; identical to SEQ ID NO: 69545

SEQ ID NO: 69552 - protein, 297 aa, Homo sapiens; identical to SEQ ID NO: 69540

SEQ ID NO: 69553 - protein, 1063 aa, Homo sapiens
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSEWGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 69554 - protein, 257 aa, Homo sapiens
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRVFYHGCWLLSGCD

SEQ ID NO: 69555 - protein, 1063 aa, Homo sapiens; identical to SEQ ID NO: 69553

SEQ ID NO: 69556 - protein, 115 aa, Homo sapiens
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYP

SEQ ID NO: 69557 - protein, 326 aa, Homo sapiens
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDG

SEQ ID NO: 69558 - protein, 1093 aa, Homo sapiens
MGGKAWPRRAVGTAGGPCAEQISAPFQTLLMPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSEWGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 69559 - protein, 923 aa, Homo sapiens
MCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSEWGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 69560 - protein, 294 aa, Homo sapiens
MASASGAMAKHEQILVLDPPTDLKFKGPFTDVVTTNLKLRNPSDRKVCFKVKTTAPRRYCVRPNSGIIDPGSTVTVSVMLQPFDYDPNEKSKHKFMVQTIFAPPNTSDMEAVWKEAKPDELMDSKLRCVFEMPNENDKLGITPPGNAPTVTSMSSINNTVATPASYHTKDDPRGLSVLKQEKQKNDMEPSKAVPLNASKQDGPMPKPHSVSLNDTETRKLMEECKRLQGEMMKLSEENRHLRDEGLRLRKVAHSDKPGSTSTASFRDNVTSPLPSLLVVIAAIFIGFFLGKFIL

SEQ ID NO: 69561 - protein, 249 aa, Homo sapiens
MASASGAMAKHEQILVLDPPTDLKFKGPFTDVVTTNLKLRNPSDRKVCFKVKTTAPRRYCVRPNSGIIDPGSTVTVSVMLQPFDYDPNEKSKHKFMVQTIFAPPNTSDMEAVWKEAKPDELMDSKLRCVFEMPNENDKLNDMEPSKAVPLNASKQDGPMPKPHSVSLNDTETRKLMEECKRLQGEMMKLSEENRHLRDEGLRLRKVAHSDKPGSTSTASFRDNVTSPLPSLLVVIAAIFIGFFLGKFIL

SEQ ID NO: 69562 - protein, 99 aa, Homo sapiens
MAKVEQVLSLEPQHELKFRGPFTDVVTTNLKLGNPTDRNVCFKVKTTAPRRYCVRPNSGIIDAGASINVSGRRWTADEEDSAEQQPHFSISPNWEGRRP

SEQ ID NO: 69563 - protein, 243 aa, Homo sapiens
MAKVEQVLSLEPQHELKFRGPFTDVVTTNLKLGNPTDRNVCFKVKTTAPRRYCVRPNSGIIDAGASINVSVMLQPFDYDPNEKSKHKFMVQSMFAPTDTSDMEAVWKEAKPEDLMDSKLRCVFELPAENDKPHDVEINKIISTTASKTETPIVSKSLSSSLDDTEVKKVMEECKRLQGEVQRLREENKQFKEEDGLRMRKTVQSNSPISALAPTGKEEGLSTRLLALVVLFFIVGVIIGKIAL

SEQ ID NO: 69564 - protein, 524 aa, Homo sapiens
MDTESTYSGYSYYSSHSKKSHRQGERTRERHKSPRNKDGRGSEKSVTIQPPTGEPLLGNDSTRTEEVQDDNWGETTTAITGTSEHSISQEDIARISKDMEDSVGLDCKRYLGLTVASFLGLLVFLTPIAFILLPPILWRDELEPCGTICEGLFISMAFKLLILLIGTWALFFRKRRADMPRVFVFRALLLVLIFLFVVSYWLFYGVRILDSRDRNYQGIVQYAVSLVDALLFIHYLAIVLLELRQLQPMFTLQVVRSTDGESRFYSLGHLSIQRAALVVLENYYKDFTIYNPNLLTASKFRAAKHMAGLKVYNVDGPSNNATGQSRAMIAAAARRRDSSHNELYYEEAEHERRVKKRKARLVVAVEEAFIHIQRLQAEEQQKAPGEVMDPREAAQAIFPSMARALQKYLRITRQQNYHSMESILQHLAFCITNGMTPKAFLERYLSAGPTLQYDKDRWLSTQWRLVSDEAVTNGLRDGIVFVLKCLDFSLVVNVKKIPFIILSEEFIDPKSHKFVLRLQSETSV

SEQ ID NO: 69565 - protein, 524 aa, Homo sapiens; identical to SEQ ID NO: 69564

SEQ ID NO: 69566 - protein, 524 aa, Homo sapiens; identical to SEQ ID NO: 69564

SEQ ID NO: 69567 - protein, 522 aa, Homo sapiens
MDTESTYSGYSYYSSHSKKSHRQGERTRERHKSPRNKDGRGSEKSVTIQPPTGEPLLGNDSTRTEEDDNWGETTTAITGTSEHSISQEDIARISKDMEDSVGLDCKRYLGLTVASFLGLLVFLTPIAFILLPPILWRDELEPCGTICEGLFISMAFKLLILLIGTWALFFRKRRADMPRVFVFRALLLVLIFLFVVSYWLFYGVRILDSRDRNYQGIVQYAVSLVDALLFIHYLAIVLLELRQLQPMFTLQVVRSTDGESRFYSLGHLSIQRAALVVLENYYKDFTIYNPNLLTASKFRAAKHMAGLKVYNVDGPSNNATGQSRAMIAAAARRRDSSHNELYYEEAEHERRVKKRKARLVVAVEEAFIHIQRLQAEEQQKAPGEVMDPREAAQAIFPSMARALQKYLRITRQQNYHSMESILQHLAFCITNGMTPKAFLERYLSAGPTLQYDKDRWLSTQWRLVSDEAVTNGLRDGIVFVLKCLDFSLVVNVKKIPFIILSEEFIDPKSHKFVLRLQSETSV

SEQ ID NO: 69568 - protein, 521 aa, Homo sapiens
MDTESQYSGYSYKSGHSRSSRKHRDRRDRHRSKSRDGGRGDKSVTIQAPGEPLLDNESTRGDERDDNWGETTTVVTGTSEHSISHDDLTRIAKDMEDSVPLDCSRHLGVAAGATLALLSFLTPLAFLLLPPLLWREELEPCGTACEGLFISVAFKLLILLLGSWALFFRRPKASLPRVFVLRALLMVLVFLLVVSYWLFYGVRILDARERSYQGVVQFAVSLVDALLFVHYLAVVLLELRQLQPQFTLKVVRSTDGASRFYNVGHLSIQRVAVWILEKYYHDFPVYNPALLNLPKSVLAKKVSGFKVYSLGEENSTNNSTGQSRAVIAAAARRRDNSHNEYYYEEAEHERRVRKRRARLVVAVEEAFTHIKRLQEEEQKNPREVMDPREAAQAIFASMARAMQKYLRTTKQQPYHTMESILQHLEFCITHDMTPKAFLERYLAAGPTIQYHKERWLAKQWTLVSEEPVTNGLKDGIVFLLKRQDFSLVVSTKKVPFFKLSEEFVDPKSHKFVMRLQSETSV

SEQ ID NO: 69569 - protein, 513 aa, Homo sapiens
MTTQLPAYVAILLFYVSRASCQDTFTAAVYEHAAILPNATLTPVSREEALALMNRNLDILEGAITSAADQGAHIIVTPEDAIYGWNFNRDSLYPYLEDIPDPEVNWIPCNNRNRFGQTPVQERLSCLAKNNSIYVVANIGDKKPCDTSDPQCPPDGRYQYNTDVVFDSQGKLVARYHKQNLFMGENQFNVPKEPEIVTFNTTFGSFGIFTCFDILFHDPAVTLVKDFHVDTIVFPTAWMNVLPHLSAVEFHSAWAMGMRVNFLASNIHYPSKKMTGSGIYAPNSSRAFHYDMKTEEGKLLLSQLDSHPSHSAVVNWTSYASSIEALSSGNKEFKGTVFFDEFTFVKLTGVAGNYTVCQKDLCCHLSYKMSENIPNEVYALGAFDGLHTVEGRYYLQICTLLKCKTTNLNTCGDSAETASTRFEMFSLSGTFGTQYVFPEVLLSENQLAPGEFQVSTDGRLFSLKPTSGPVLTVTLFGRLYEKDWASNASSGLTAQARIIMLIVIAPIVCSLSW

SEQ ID NO: 69570 - protein, 520 aa, Homo sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTGSGIYAPNGPKVYHYDMKTELGKLLLSEVDSHPLSSLAYPTAVNWNAYATTIKPFPVQKNTFRGFISRDGFNFTELFENAGNLTVCQKELCCHLSYRMLQKEENEVYVLGAFTGLHGRRRREYWQVCTLLKCKTTNLTTCGRPVETASTRFEMFSLSGTFGTEYVFPEVLLTEIHLSPGKFEVLKDGRLVNKNGSSGPILTVSLFGRWYTKDSLYSSCGTSNSAITYLLIFILLMIIALQNIVML

SEQ ID NO: 69571 - protein, 166 aa, Homo sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVV

SEQ ID NO: 69572 - protein, 467 aa, Homo sapiens
MNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTGSGIYAPNGPKVYHYDMKTELGKLLLSEVDSHPLSSLAYPTAVNWNAYATTIKPFPVQKNTFRGFISRDGFNFTELFENAGNLTVCQKELCCHLSYRMLQKEENEVYVLGAFTGLHGRRRREYWQVCTLLKCKTTNLTTCGRPVETASTRFEMFSLSGTFGTEYVFPEVLLTEIHLSPGKFEVLKDGRLVNKNGSSGPILTVSLFGRWYTKDSLYSSCGTSNSAITYLLIFILLMIIALQNIVML

SEQ ID NO: 69573 - protein, 102 aa, Homo sapiens
MNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPP

SEQ ID NO: 69574 - protein, 101 aa, Homo sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIP

SEQ ID NO: 69575 - protein, 500 aa, Homo sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRFGNTPVQQRLSCLAKDNSIYVVANIGDKKPCNASDSQCPPDGRYQYNTDVVFDSQGKLLARYHKYNLFAPEIQFDFPKDSELVTFDTPFGKFGIFTCFDIFSHDPAVVVVDESIDSILYPTAWYNTLPLLSAVPFHSAWAKAMGVNLLAANTHNTSMHMTGSGIYAPEAVKVYHYDMETESGQLLLSELKSRPRREPTYPAAVDWHAYASSVKPFSSEQSDFLGMIYFDEFTFTKLKRNTGNYTACQKDLCCHLTYKMSEKRTDEIYALGAFDGLHTVEGQYYLQICALLKCQTTDLETCGEPVGSAFTKFEDFSLSGTFGTRYVFPQIILSGSQLAPERHYEISRDGRLRSRSGAPLPVLVMALYGRVFEKDPPRLGQGSGKFQ

SEQ ID NO: 69576 - protein, 274 aa, Homo sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRFGNTPVQQRLSCLAKDNSIYVVANIGDKKPCNASDSQCPPDGRYQYNTDVVFDSQGKLLARYHKYNLFAPEIQFDFPKDSELVTFDTPFGKFGIFTCFDIFSHDPAVVVVDEFQLTAFSTPQHGTTRCPSSRLFPSIQHGPRPWESIYLLQIPTTPACT

SEQ ID NO: 69577 - protein, 147 aa, Homo sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRKSKKMNEPVSKELCYHCHSECNQYGQWKLYRT

SEQ ID NO: 69578 - protein, 207 aa, Homo sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRFGNTPVQQRLSCLAKDNSIYVVANIGDKKPCNASDSQCPPDGRYQYNTDVVFDSQGKLLARYHKGVESTPQKQSRCTTMTWKQRVVSCCYQN

SEQ ID NO: 69579 - protein, 186 aa, Homo sapiens
MSPKPRASGPPAKATEAGKRKSSSQPSPSDPKKKTTKVAKKGKAVRRGRRGKKGAATKMAAVTAPEAESAPAAPGPSDQPSQELPQHELPPEEPVSEGTQHDPLSQEAELEEPLSQESEVEEPLSQESQVEEPLSQESEVEEPLSQESQVEEPLSQESEMEEPLSQESQVEEPPSQESEMEELPSV

SEQ ID NO: 69580 - protein, 206 aa, Homo sapiens
MSPKPRASGPPAKATEAGKRKSSSQPSPSDPKKKTTKVAKKGKAVRRGRRGKKGAATKMAAVTAPEAESAPAAPGPSDQPSQELPQHELPPEEPVSEGTQHDPLSQEAELEEPLSQESEVEEPLSQESQVEEPLSQESEVEEPLSQESQVEEPLSQESEVEEPLSQESQVEEPLSQESEMEEPLSQESQVEEPPSQESEMEELPSV

SEQ ID NO: 69581 - protein, 139 aa, Homo sapiens [sequence omitted]

SEQ ID NO: 69582 - protein, 186 aa, Homo sapiens
MSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEVEEPLSQESQVEEPLSQESEMEELPSV

SEQ ID NO: 69583 - protein, 166 aa, Homo sapiens
MSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEMEELPSV

SEQ ID NO: 69584 - protein, 125 aa, Homo sapiens
MSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQERPATPLSP

SEQ ID NO: 69585 - protein, 125 aa, Homo sapiens
MSPKPRASGPPAKAKETGKRKSSSQPSPSGPKKKTTKVAEKGEAVRGGRRGKKGAATKMAAVTAPEAESGPAAPGPSDQPSQELPQHELPPEEPVSEGTQHDPLSQESELEEPLSKGRPSTPLSP

SEQ ID NO: 69586 - protein, 739 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 69587 - protein, 647 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQAFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 69588 - protein, 540 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 69589 - protein, 677 aa, Homo sapiens
MPGKMVVILGASNILWIMFAASQAFKIETTPESRYLAQIGDSVSLTCSTTGSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 69590 - protein, 521 aa, Homo sapiens
MEANWTAFLFQAHEASHHQQQAAQNSLLPLLSSAVEPPDQKPLLPIPITQKPQGAPETLKDAIGIKKEKPKTSFVCTYCSKAFRDSYHLRRHESCHTGIKLVSRPKKTPTTVVPLISTIAGDSSRTSLVSTIAGILSTVTTSSSGTNPSSSASTTAMPVTQSVKKPSKPVKKNHACEMCGKAFRDVYHLNRHKLSHSDEKPFECPICNQRFKRKDRMTYHVRSHEGGITKPYTCSVCGKGFSRPDHLSCHVKHVHSTERPFKCQTCTAAFATKDRLRTHMVRHEGKVSCNICGKLLSAAYITSHLKTHGQSQSINCNTCKQGISKTCMSEETSNQKQQQQQQQQQQQQQQQQQQHVTSWPGKQVETLRLWEEAVKARKKEAANLCQTSTAATTPVTLTTPFSITSSVSSGTMSNPVTVAAAMSMRSPVNVSSAVNITSPMNIGHPVTITSPLSMTSPLTLTTPVNLPTPVTAPVNIAHPVTITSPMNLPTPMTLAAPLNIAMRPVESMPFLPQALPTSPPW

SEQ ID NO: 69591 - protein, 521 aa, Homo sapiens; identical to SEQ ID NO: 69590

SEQ ID NO: 69592 - protein, 457 aa, Homo sapiens
MRPPSPLPARWLCVLAGALAWALGPAGGQAARLQEECDYVQMIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 69593 - protein, 416 aa, Homo sapiens
MIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 69594 - protein, 247 aa, Homo sapiens
MTRQRVWMRWAVRQPWSFSNIVSWLTSSGCWWRASTCTPCLPSPSSLSGSTSGGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 69595 - protein, 409 aa, Homo sapiens
MRAGRRPRLGPWAGGCSKMWDNLTCWPATPRGQVVVLACPLIFKLFSSIQGRNVSRSCTDEGWTHLEPGPYPIACGLDDKAASLDEQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 69596 - protein, 438 aa, Homo sapiens
MRTLLPPALLTCWLLAPVNSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 69597 - protein, 422 aa, Homo sapiens
MPLWEAPSDHPANPPATLQGHTSLPGCQEEPARDPQSGLPQITSESSSFSEGSLPSWSSGPAGAKLNASHEGIGSSSDGNGDSKAATERVVSAMDTVRRKHPEITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 69598 - protein, 77 aa, Homo sapiens
MRTLLPPALLTCWLLAPVNSIHPECRFHLEIQEEETKCAELLRSQTEKHKGHTKGFILIHAGGLKRILDPHTYPLAP

SEQ ID NO: 69599 - protein, 673 aa, Homo sapiens
MCSRVPLLLPLLLLLALGPGVQGCPSGCQCSQPQTVFCTARQGTTVPRDVPPDTVGLYVFENGITMLDAGSFAGLPGLQLLDLSQNQIASLPSGVFQPLANLSNLDLTANRLHEITNETFRGLRRLERLYLGKNRIRHIQPGAFDTLDRLLELKLQDNELRALPPLRLPRLLLLDLSHNSLLALEPGILDTANVEALRLAGLGLQQLDEGLFSRLRNLHDLDVSDNQLERVPPVIRGLRGLTRLRLAGNTRIAQLRPEDLAGLAALQELDVSNLSLQALPGDLSGLFPRLRLLAAARNPFNCVCPLSWFGPWVRESHVTLASPEETRCHFPPKNAGRLLLELDYADFGCPATTTTATVPTTRPVVREPTALSSSLAPTWLSPTEPATEAPSPPSTAPPTVGPVPQPQDCPPSTCLNGGTCHLGTRHHLACLCPEGFTGLYCESQMGQGTRPSPTPVTPRPPRSLTLGIEPVSPTSLRVGLQRYLQGSSVQLRSLRLTYRNLSGPDKRLVTLRLPASLAEYTVTQLRPNATYSVCVMPLGPGRVPEGEEACGEAHTPPAVHSNHAPVTQAREGNLPLLIAPALAAVLLAALAAVGAAYCVRRGRAMAAAAQDKGQVGPGAGPLELEGVKVPLEPGPKATEGGGEALPSGSECEVPLMGFPGPGLQSPLHAKPYI

SEQ ID NO: 69600 - protein, 845 aa, Homo sapiens
MELWRQCTHWLIQCRVLPPSHRVTWDGAQVCELAQALRDGVLLCQLLNNLLPHAINLREVNLRPQMSQFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPPKMTEYDKRCCCLREIQQTEEKYTDTLGSIQQHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 69601 - protein, 748 aa, Homo sapiens
MSQFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 69602 - protein, 813 aa, Homo sapiens
MELWRQCTHWLIQCRVLPPSHRVTWDGAQVCELAQALRDGVLLCQLLNNLLPHAINLREVNLRPQMSQFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 69603 - protein, 845 aa, Homo sapiens; identical to SEQ ID NO: 69600

SEQ ID NO: 69604 - protein, 868 aa, Homo sapiens
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMKMGMTEDDKRNCCLLEIQETEAKYYRTLEDIEKNYMSPLRLVLSPADMAAVFINLEDLIKVHHSFLRAIDVSVMVGGSTLAKVFLDFKERLLIYGEYCSHMEHAQNTLNQLLASREDFRQKVEECTLKVQDGKFKLQDLLVVPMQRVLKYHLLLKELLSHSAERPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFRTSGDRDASGAGPGPKMVAMQNYHGNPAPPGKPVLTFQTGDVLELLRGDPESPWWEGRLVQTRKSGYFPSSSVKPCPVDGRPPISRPPSREIDYTAYPWFAGNMERQQTDNLLKSHASGTYLIRERPAEAERFAISIKFNDEVKHIKVVEKDNWIHITEAKKFDSLLELVEYYQCHSLKESFKQLDTTLKYPYKSRERSASRASSRSPASCASYNFSFLSPQGLSFASQGPSAPFWSVFTPRVIGTAVARYNFAARDMRELSLREGDVVRIYSRIGGDQGWWKGETNGRIGWFPSTYVEEEGIQ
